United States Patent 9,328,346 (POLYCOMB-ASSOCIATED NON-CODING RNAS) - sequence listing, part 63

SEQ ID NO: 12447 - RNA, 93095 nt, Mus musculus
auauaagugaagcaaauauuuuuauugaaaucaguugucaaaucacaauuuauccaaaggaacauaauguaacauuguucuuaaaagaaggggcacagauauaauacagacaaacuccaguaucuaucaaaauaccaucuguaaagagcaggucucacuucaaucugcauaugaauucgguccagccuagaagaguacaauccaaaaaguaacaacaaauuccuucugcguuaggaaauagcucauggccauggcacacucaucuguccauauuguuaagagauggggcuuaaucugacacuaaggagacuucuuuccaaccuggacuggauuagaaaaaaaaaaaaaaaauguugucguaauguugggacauucugaaugucucaaaauggaguuuuuauuucugagcucacugugcauaggaaaacaaccacuuucagaggacuacgagcccacagaguuaagcaucaguaaacuuuaaaaagacuuguaucuuccugccaggaauguuauuucucuguuugcugcagguuacaguugaggcuuggggcuucucaaagcuucgcuauggcugcacacccauuauauacugcauaauacaaaaggcaugugcuuaaaccuuagaaaaaaaauauacaauagguacaggaggaggacuacauaaaacauacauauaaauacauaaaggaggaggcuccaguuugagaagugggacuagguauugccgacauugguuccagguggagaaagcaggaccuuaacucugaaauacauggcaccaaggggcaaaucaagggcagucuugaaaagaggaaauguuagcuggcucuagcucccgaugcagccucaggauugucggggugcucugcaggguugaaaucauuggacggcucugcucucugcaccucaagggcucugaaauuuuggucucaaggucccaacagcagcaucuuguuccgugacuucacuucacauucuaguuuuacaaugagcaacuggagaaagaagagagagaagagauaaaauuccccuuucuuuccucauuguauggacaacaggauaacugcccaagagccacaggaauggggagcucuggguauggggagcuccaggcccuaaauuaaaguguuaaaaguuuuggcugagcugggugugauggugcacaccuuuaaucucagugggggaaggagagaggcgaggcuagccuggucugcauggugaguuccaggacagccaggacuacauagugagaccugggcucaaaacaacaacagcagcagcaaaauuaagccauuauuuucauuauaucagcaagacuugggauucugaugagguaaaaaaaaaaaaaaacaaacaaaaaaaccaaaccaaacaaaaaauucaaauauccacccuagauccaacuguaguugauaauuauuuccaacugaagguugguucuguauaaaaucaguuaucugucuguguaauugcauagauggggcagggaaacggguggaggaggacuagccauccagaaggaaguuuaccuaccucacgucuuaggauucugucaggucucccuuuggcuccuguaggucguccucuucugucugggccuuguucauuucuucuuucagggcaucuccuuccucgguuagcuuugguccguuggugucuggggacucuuugguuagauuuccagaggcauccgccucugccuuggcuaagcuuuggugcugggggccgucagcagcauguuccuuuucaucuuugcacugaagaggcagcuucucaacacuuucuuugacacuggcacuuucaacugcaagcguggugaucauuucugaagccuugcucaugccuucagaacuaucagaaaccgcaaguccuuccugggcuacggcacugaguguuccaucuuggggggagacuugaaggucgcuuucaucuuuguccagcaucuguugugcucccuggcugucagccugcaucacaggaaccugauucuguaaaucagaagcguggguuucgggggcuguuucuguacgugcaaacuggucgacggcugucuggaugacacucuggacaaucuuauugcucuuacucucaaguuccaagaucucagguucagcccugaggauuuucucucuugcugcacucuccuugccggcagcaucaggaccagcaucuggcuuguuaucuucaucugaucucuguuucugggaugcgcucacuucucuuugaaggucagaauguaggaugcuuucaggagcaggaguuacuauuauugggauggacucugccugagacucaggccccuggggcacgguguccucuccaugcugaagagucccguagccaccgguuucggagagcuucucagcugguaaugauugcgcaccugcacacuccaaacuuucauccaucucugaaguugccacaguuucuucgaccuuuuucacagcuucgguuguuugagugacuggugugucugagcuuugaacuugaaccucuaugcaaucugcuuugucuuggucugggagagaagggcuuccuucaaggcugcccagugccuuuccccucucugagugaggcaugucagcugucaggacuggcuuaggguggguuccuucaugcucaggagcagcuguuuccugcucauguucuucacuggcuugcucugucuuggucucuguuuccuccuuuucaacgucgguucccaucucucuuuucuccgggcuaauacucuguucuucauuacucucaguuuccugacaucuggccacuuccauuacuucacugucacgugucaagucagcagucuuuugacuguuggguccagugugcacaggcaccuccaguucuuuaacacacuguccgucuuugacuuuuucuccaucaaacuggccagccucacccucuugacccaccucagccuuugccagaauaggcacugccccggcagccagcgcuuguguggguucuagaacaucccuuccugguuuuucccuguguucuuccugggcuggaaaacuagaugguguugaaggccccuccgucugagcagcagcugccuccucuucagugaccugugacugcuugacggcggcaauggcauuacuguccuggcugucaacggucucgucuugcugugucccguuuggagugucugaaucugcgaggggaguacuuccauuugucucacugucugucaagguuucagaugacucaggggccacagccuguuccaucagcugcuggugcuugauaaccuggcaugugguggcacggucuacauccucugugacuucaggaacuucaaggcucucugggguagccuguacagucucggagcccugugcaagaugcucaguuucagcuuccugcacggguccuuccggcacaacauccuucucuuucucgguagccagcaccucggaguccuccucuaccuccuccaccuucuccagugcuuucggcccugcucucugcagagucuggguugcaggcaccugggaguccucuuucacuuugucugcaacggcuuggaggacggccugcgucuggcgcuccuguucuuccguaucuagcaugccacccucuaccuccugaacugggguggcuuccucugugguguccggggagucggacagcugggaaacugcagacaccaugucuguggucucuucugccccugaugcuucgguaaguucuucagcgcggagcgccucugugguuucugcggcugucacugcuucugagguaaaauccacuucacuggugacuaugucgucaugggcaucuuugcccccugguaaagucugggcgagugcaggaguugcuucugcagugaugucuuuuucagugaccucuccaacaggcgguguggccacucccucugcgugcucaagagguucugucauggaagcagauauccacgaaggggaccgcucuucggcacuggugacugcccuggucccaucaaugaccgcgacacucacggugugaaccagagucuuacuaagcuccucagacacauacacagcccccuucagcuggggcagcuccacguucuccugagcucgcugcgcuuccagcuucucucucucuaccgcaucguacucagacagaggcacaacagcugggacgucggggucguccucauugaucucuccuggccccgagucuucaacggcggccuguucuugcuucccaucugcccuuuucuuccgccguccaggaauaaauuucuuaauggaaacccaagauuccucucuacuugguucgaucucggaggccaacugcucugcaccggagucuucggcucucucuuccaguuuugacuuggauuuuuuucguggagugacuaaucucuuaaaugacucccagguggagacgcccuccccuucagaagggcuuccagcuggcucgggugaggaacuuccgugcgcuuggucuuguuccugggugcuggcaggaagagcaucugcuucuuugucuuugcuagccuccuccgcucuguggccauccccucccaguguucuuggcccuccuucaucaucugaagaggaugccuuccucgcucucuucuuggacgauccgacacaaaucaacgccucccaagacacugaaguauccacccugcgcuuuggcuccucugaccuuugcuccucgccaaccgcucugaccucauccugcauuccagacgccgugcucuccguggaggacaagguggcacucuugaccuuauccagcucuucuuccuugucgcucucagaaggucuucggacccguuucuugggugucaccaucuuuuugaaggaugcccagggggugaucccuucccuuuucuucucuccgucggaagucgcuccuuccucagcuuccgcuuccuggggugcuuccgauggccccuucuccagacacgcgaucuccucgggcucuucaggggaagaggcagagcucucucccuucugcucgucagcacucucuggggacucgguuugaauguguugguauucuccuggcucuucaucucccccgccuccuccucucuuccccuucugcuucuucccggagagcuucuuuaagcccgaacugcugaagagcuucuucaggggacuucccuguaccuugauucucuccugagaggacagcaucuccaccucacugacaaugccuucgggguguuuggguagcaucuucucuucaggacuuagaucugucagcugaguauggucacccccagagacgcauacuucuuuggucuucaucagcuccuccacaggcucagcuuccugggggaccuccugggucucagccaguuucucagggggcaaggauucucccgauccuuccaccaccacauccccuuccaccucugcuccuccuugcccuuucgucaucuucuccacggugcucacguggaccucugcaacaacuucuuggugggcuuccgucuucucaucaaacacuuccguugccaaaggagcacacuucuccgacaaugccuccaggucaccgaccuggucuuccaaaggcaacuccaccuucucauagucggcugacaaccuggccuggucugugccuucugcaggcuccugcuccucggcuggggcuggcucugucuuuuccccuucuuccucgucuacuuuuucagccucuugcuccuuucucuucucggaaguuuccagaucaucuuccuuugguuucuugaagcuggucuucuugcgccagccggcccagccgugagugaagaauuucuugaaggaagauguugucucauugcugacagggcuggucggagauucuaggggcuugguagguucuuucucucgguuuucuucuccaucuuuggcugcuucuuccucggucccuugaccagauucggcuugaaggggaauuucugugcugcucugugcuugcuucagggugccuucuugcuucucuguggauugcuucagcucacuuucuuuggaugcugauucgccgacggucuccacuccgggcucuugguggucuccugcuccgacggaggcuucugccccuucgccuucauccuucuugacagugaguagcuggacgguaucugacuuuucguuuuuauccuucuucaccgugaauuuaaaaccaacaaauuuaaauaccuucuugaagccgacgucauuagcuugggacucagcagccugcgccauuucuuccacauugcucucugaagcagggaucuguucgauuauuuccgguguuuccuccugcucguccuuugugauaucuucaacaacuguggaacuggcugccauuucuuuagcucggucuuuuucuuucacaucuucugacucucucuguccaacuauuaacaagggaaauggagaagaagggaaaauuacuuuguucaacaagcguaacacucuccuuaguaguacagcguaguagauuguggaaguauuuguaaauguuucauagauuggaccauggcuacuccuuuccaaggagcaacuaaaaccucuucaaaggcgcuacacgcuuggcuccuuaccucuccuuucuuggcuguugagauauuaguuacauggacugcagacagagaugccucagugcuuaauagcacaugcuguuuuuguagaggaccuggaggcucaauuccaaacaccuacaugguggcuggauccaacauccuguucuggccucuaugggcacugaacacacaguacacagguguguauauaugcaagcaaaauguauacaaggaaaggauaucauuuuuuaaaaauccucaugaaugcaugaguagggauacaaaaacaagauccaguaaaugaggagugaggaguauuuuuuuuuuuuuuuuuuugguuuuucgagacaggguuucucuuuauagcccuggguguccuggaacucacuuuguagaccaggcuggccucgaacucagaaauccaccugccucugccucccgagugcugggacuaaaggugugcgccaccacgcccggcaaagaguacuauuuuuuuaaaaaagauuuauuuauuauauguaaguucacuguagcuaucuucagacacuccagaagagggugucagaucucauugugagccaccaugguuguggcucacaugugguugugagccaccaugagguugcugggauuugaacucaggaccucuggaagagcaguuagggcucuuaaccacugagucaucucuccagcccgaggaguacuauuuaaaaaacaaaaucaggccgggccuugguggcacaugccuuugaucccagcacuugggaggcagaggcaggcggauucauucugaguuucagugccaaaccaaauaugaagguggggguggggggugggggagggggagucgggaagaggaggucuguuacuuagagaacaggggcaggaaggacugcaagcuugaggaccauccugggcaaagugagaccucgucucaaaaguaaaaaauaaagccgggcauggugagcuaugucuguaaucccagagagcuugagaggcagaggaggucgauuccugugaguuccaggaugacauaauaugucucaauuaaauaaucugccucgggcuggcgagauggcucagcggguaagagcgcugacugcucuuccaaagguccugagugcaaaucccagcaaccacaugguggcucacaaccaucuguaacgagaucugacgcccucuucugggugucugaagacagcuacaguguacuuacauauaauaauaaauaaauaaauaaaaauaaucugccucaaauaaauaaacuaaaauaauaauaaaaaauaugguggucggaauaguacauacagucaagaaucaaacguugcuaaauucacugggagaaaaguuuacaggaagcauaaaguuucagaauguugaagucugcccccauaguauagcuggagccauuuuguuccaugccugccagcuauuuccuauuguugcuauaacaugccuaacagucacugacugagaaaaauaacuugacucagagcagggucaugcugaccacauacccuguuaugcucuauaugcuauaagguuuauuaaucuuaagaaauucaacaaccugggcuggugagauggcucaguggguaagagcacccgacugcucuuccaaagguccagaguucaaaucccagcaaccacaugguggcucacaaccaucuguaacaagaucuggcgcccucuucuggagugucugaagacagcuacaguauacuuacauauaauaaauaaauaaaucuuuaaaaaaaaaaaaaaaaaagaaauucaacaaccauaagcuucacuuaggacccaagugaucaggccugacaaccugugggaaucacugagaaagcacaugucagauucccaaugaauggaaucuaguugugaggaaaugauaggccaaaggcgccccgugcucagccuggucugcuaagccaaugacacaaaaggccaagguuaagcaggaagguuuguuugcaagaaacuucaaaggcuggagaggagggagaaagaaugugguaggcuauugaugaugcugugauuuucuguuauaucagcauuuaaggaaauuaaaaaaaaaaaaaaaaaaaaagauuggguagggucuggagagagcgguuaagagcugugacugcucuuccagagguccugaguucaauucccagcaaccacauggugacucacaaccaucuguaaugggaucugaugcccucuucuggugugucugaagacagcuacaguguacccacacacauaaaauaaauaauaaaucuaaaaaaaaauagauuagguguaaaaagucaaacaugauuuaaugaagcucacggggcccagggaacugcaguaugggggacauuagggacauaacuagaccccucccccggcacugaaucacacagcagcucacuagcgaaaaccaccacugaaagcauaguuggugauggggugggguggggauguuuguaagaaugauuuaaaauuaggugagguuuauuuuuguaaaaugagggagugcaggcuuugaaagaccaacaaguaacuucauuuuagccuaaauucucugccccaucuuucacaaauuauuaucaauuaucauagggagggauuuaguaugugauauguuuuaaucauuuugcuagucugaguucaauuucaugcacuucuaaagcagcacaggauauguacuucuuuauguaacagacgaaaagguccauucaaacuggcggaacauuugacuacaggaaggguaggcagauuggcaguccagugccagcuugggguacucacaaagauccugucucaaaauaaaacauaaacuggggcuguaguucagugguggaguguuugccuaguaugcucaagguccuguguuccacacccaucaccaacaacaaggaggaugcuggggaacuccuaugaucucauccauccaucuaucuaucacaaacucgagugguccacucauauaaggaagcaauauagcuaauacaugcauauuucaaaacugcuauaauaaaauuuuuagugguguuaccacaauaaaauaacauggucacauaauggcuacguuaauuaguuugaauggaucuauagucugugcauggcuccaugauuuuugacuuguuagccuucagaaccgugugcaaauauauuuaccacuuaaaacauggagaaaaggaagaggaaaacaaaaucauacuuugaugaaaacagcaauuuuacuccagaaaauauacacaauuguuauuucucuauugagaaucuaaaguuagccaagagucagagguaggcagaucucugaguucaaggccagccuggucuacagagugaguuccaggacagccagggcuacacagagacccccccccccccacccaauccccgucucaaaaaaaaaaaaaaaaaaaagagaaaggaaggaaggaagauacucuaauucuuugcuucuuggaagguaaguuauugugggcuugugcuacaagguggagaaauaaaaucagucacugacaaacucauuaaauguuacuaauaacugggaaaaguauaaaggauucucuuacuccaagcccaagacuaaaauacccccuugccuucucuggggguaggaaaugcaagaauuuucuugaacaggguaauaaagagcaguauuccacaccauugccucuacaaguuaauaggaaagacuuuuaaauucauuuuuaaauauuuauuuuuauuuaucuuaugugugucugugugagugaaggccucguaugugaaauuaacacaaaagccaaaagagggagucagaucccuuggaaguggggagccugcuaaguccucuuuuuuauuuauuuuuuuuccuucucucucuggccugcuagcuccagcccaaagauuuauuauauguaaguacacuguaacugucuucagacaccccagaagagggcaucagaucucauuacggaugguugugaaccaucaugugguugcugagauuugaacucaugaccucuggaagagcagucagugcucuuaacuggugagcauucucgccagcccccccccccccaccuuuaaguccucucaagaaagcaagaacucaauagagcaauuucucuagucuccauaacaauuaaaaagauuuauuuucccuacaaauaauuuuuuuggguuuuuuuuugagacaggguuucucuguguaguccuggcuguccuggaacucacucuguagaccaggcuggccucgaacucagaaauccgccugccucugccucccgagugcugggauuaaaggcgugagccaucuccaccggguggaaaagaaauuaaaacaaaacaaaacaaaaauccuaguuuauuuuuauguguauguucugccugcauguuauaaauauacucgcaccacucucagaggucaggagcaagacggaugguugugagccaccaggugguuaugggaaaccaaacacaggccuuccucaagaacaaacuguuuuaaucacugagccguuuucccagguccacccuuuucccuuuaaauucuacacugggugcuuagaguugagcuacaggacacaaaacaagcaggugccagccaacuagcaggacaaaacagguaaggauggcgaagcaauacucaaggaacugcuuuauguacucuuuuucuaaaacaauguugggggugggggggugggagugggggauggagagauggcucaguaguuaagagcacuggcugcucuugcagaggacccagguucaguacccacaggguagcucacagcugucucuaacuaugguuccaggggcucugacacccucucaccaaugcacauacaaaauaaaaauaaauaaauaaauaaauaaauaaauaaauaaauaaauaaauaaaugcuuaggaagucuuaaguggcuuacuaguccuguaguaaauuauaaguaaguuucuuauuuaagaacuguccuccagauacaaccccaaauuaugaacauagauagcauccuuuccgauuugccuauaggauuagacuacucugcgguuuugucggccucuucuugccucaaucccugaccccaauuuguacagaacuuacagggaaguucacuuccaaaaauucggccucuacugcauagccaagcuaucaaacauccgauggcccaagccuugagcuuagccuucgcaacuaccaagccugguggccaaggccguuuaaaucagguuccaacaggauacagaaauguccucgcgcaccacugcggcguggcccacacgcgcauuugcaaagccugcaucaugugcuugaacccacagcccacgcagagaugcgguccaccucccucuaugcuccaugguugcucucuccaggcuggggaggggguaaaaugaccucuuuagucuuggaucauuuucuggcucucuucugccaaccaccucuguuccuucuccaagcuaugguacugaaggcugugcccucugucuggcaagaagugauauuuuacucuugggguagccuguguauugacccugugugaaaaucuauuaugcuccgcugccgccccccccccccccaacaacuggagcaggggcugucccugaaucuguucccugccuguggauccuguucccuaacugaacugcucugccuugccucaguggaagaggaugugcccaguccugcaguaacuugaugugucaggagauacccugggggcccucccccuucucagaggaaaaguggaagggagugggcuguccgggaggggggcaugaggaggagacugcugagaucagaacguuaaauaaauaaauaaauaaauaaaucaagcacaugaccuucauggaggcuuggcccugcucuccaaggcuaaguugacuuuggagugcagagcucgggguuggaaagcaaugcccucuguccuggccugccucgccucucaggaagacugaaaggcuggaaaccacacaccccuaucuagagcaaucaccauucccagccaccgccacgcuacggccgccagggggcgcacuacucacaacauaaguuacuccaccagggcaugguggcugguggcccggaacagcggcccgagaggcccggccagccgcucccggcugccccaucgcggggcaccaaccggccgcggggcaggcgucggccgcccaguuggagagggguacccuuggggacggcuacauacgucacagaggccgggcauugucggccagguaaccaaggcaagcccacccccccaccccccacaaaauccagaaggaucuagaaucacgugugggggccucaccccccuagcucuagcacaggaauagacgagggcuuucuggcaguccccacucuguguaccaccuauaucugacuaccuaguuaacccucaaaguaauggccacaggcucucaggacacauuucugcguggguuuggcuuggguguaagcacuuuaaauggauaaaacccaacuguggugugguauguuccagggcuaaauucuuuccuauugccauauacagucuuaaugcuugaaggcagagccuccaacugguucagaagacacaggaacuucaaaaauggccacauagggagaaggccccuacagcgacuuggggggacaacuuggcaguuuacuacaauacuaaacacauuuuuuuauccuucgagacugcaaucaagauccuuggcucucacaaugaguugagagcuauaguacacacacacacacacacacacacacacacacacacacacacacacuugacacacuuguacuugggcacugauuucagcuucauaacugaucgaguagccaauauagaauucaguaggcaguuagguaaaaagaucguggguugacaggggauuagagaagaaagaaugaauagguaauaagggaugugcuaggcagggcuacuauacuuucugguaauaauuauauugaaaguauacacacccuugacauuugucacaauccaucgaauguacaccaccaggacaaaauuacacacucgaugcucugacuguugcugugcugugaggcuucgucauacguccauaacaaagacaccgcuuugggaaaggauuuugacaauaaagaccaaacacggaaacuuuggauuauggcuaauuuuucuaugaacccaaacugcaugcaugcaugcaugcauauauauauacacacacauacacaucacacauguacacacaauacauauaaauaaaauauauaauaaauauauaaaacuaauauauaacauauaauuauaaguguaugguacuuggagauaacugaaggcuggcuugagucagggcugcaaugggagaagcauaaaguuugucuuuuugauucuauacccuuucuuuuuuaaaaaaaaauauuuauuuuuuuauuuauuuauacacuguacacuauagcugucuucagacacuccagaaaacagcaucagauuucgucacggaugguugugagccaccaugugguugcuggaauuugaacucaggaccuuuggaagaacagucggcacucuuaaccacugagccaucucaccagccccucuauacccuuucaaaacacaaacacccccuacuccccaucccauuaaguccuuguaaaauaugaaaccuguaagugccacaagacaagaauaaguguugggacaugucaccucucccaucuggacaggaaaauuacuguauguguaaagcagacaaugauuguucuggugugaaaaguggcauuuaagccgggcgugguggcgcacgccuuuaaucccagcacucgggaggcagaggcaggcggauuucugaguucgaggccagccuggucuacaaagugagcuccaggacagccagggcuauacagagaaacccugucucgaaaaaccaaaaaaaaaaaaaaagaaaaguggcauuuauucaugcuuacuuucaguuauauugaaaccaaacaaaagagcacacacacaccccuuguccauccacugggagcgacuucaaagauccccuggccaucauuuugaaacaaggggaaaacuagcuaggacaagaaguauuuacagugcuaaaucagaauguguuugucaggcgagaaaccagaaaacaaauacagugagaaaguguguguguguguguguguguguguguguguguggagguucaguaaccaauaagggacaaaugucacucugcccaguguccugagaaggucccagcauagcauucuggcuacauuaccuaaauauugaaccaaagcagacguaaggacagcauaaaauaaaagcagccaaaaauauccuagacaggggcugcgcaugcuguucuuugugcaagaugcagccacuaaagucacaacucucagcugagguagacaggugcacucgguuugcaaaagaccagcgaggugaacugagcucaucgguggugugggugggggggcagggcuguuucucacugcuaaccggcuaauggcuuguuauauauagagucaggcagauagggagucacugacucaguuacugaugacuccaucagauucaguggauacuuccaauccagugcucacacaacacagggggcccugguuaaacugaacggucacaaaacuaaguccuggaucuggaaaagguagagagagauaagggaaggagaaggcugggaggacauaagaaaggggauguguggggugagguuucaggaaacaucacauccauggaggaaaguccuagaacaaagucuuuccuuaggggccagugagacggcucagccagugaaggugcccguugaccugaauuuuauccuggggacccacagggcagaagagaaccaguucacacaagcuguccucugacuuccauuaaaguacuucggcauucacauguauuuauguaugcauaaaauguaauuuuaaaauugcuaggugugguggcacuugccuuuaaucccagaauuugggaggcggaggcagauaggaucucugagaguucuaggccagccuugccuuacauagucaguuucaugucucucuauuccucucucccaacccuucucucucuccccucccucagcccuccuugaggcucccgggggcuggguuuacagguggguaaaauggaaaguacagcuuuccuucucccaaaggagaaagaagccagguagugguggcucgaaccuuuaaucagcacuaggcagagacaggggaaucucuugauuucgaggccagucaggucuacagagugaguuccaguacauccagggcuacacagagacaguccuaaucagucaagcuaucccaucccacccccugccgcuguauugcuccagugagccagauccccagcccaaggacuggggucuuuacauuuugacuaaaacgcuauucucaccugaggaauaccgaauggcagagaagcaccuaaaaaaauauucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaggcuuguacaacccucuggaaaucagucuggcgguuccucagaaaauuggacauaguacuaccagaggauccagcaauaccucuccugggcauauauccagaagaugucccaaccaguaagaaggacacaugcuccacuauguucauagcagccuuauuuauaauagccagaagcuggaaagaacccagaugccccucaacagaggaauggauacagaaaaugugguacauuuacacaauggaguacuacucagcuauuacaaagaaugaauuuaugaaauuccuagccaaauggauggaccuggagggcaucauccugagugaggugacacauuaacaaaggaacucacacaauauguacucacugauaaguggauauuagcccaaaaccuaggauacccaagauauaagauacaauuugcuaaacacaugaaacucaagaagaaugaagacugaaguguggacacuaugccccuccuuagaauugggaacaaaacacccauggaaggaguuacagagacaaaguuuggagcugagacgaaaggaugaaccauguagagacugccauauccagggauccaccccauaaucagccuucaaacgcugacaccauugcauacacuagcaagauuuuaucgaaaggacccagauguagcugucucuugugagacuaugccggggccuagcaaacacagaaguggaugcucacagucagcuauuggauggaucacagggcucccaauggaggagcuagagaaaguacccaaggagcuaaagggaucugcaacccuauaggcggaacaacauaaugaacuaaccaguaucccagagcucuugacucuagcugcauauguaucaaaagauggccuagucggccaucacuggaaagagaggcccauuggacacgcaaacuuuauaugccccaguacaggggaaugccagggccaaaaaaaaugggaauggguggguagggaaguggggggggaggguaugggggacuuuugggauagcauuggaaauguaauugaggaaaauauguaauaaaaaauauuuaaaaaaaaaaaaccacacacacacacacacagccggcuaauuaguaagcuggcugguuaugcucauccaaaacucaaauggcuuuguuuuguuuuucaaaaacaaaugugcuuauuguuuuguguuggcuuugguuuuuuuuaaagauuuauuuauuuauuauauguaaguacacuguagcugucuucagacacuccagaagagagagucagauuucauuacggaugguugugagccaccaugugguugcugggaauugaacucaggaccuucggaagagcagucagugcucuuaaccgcugagcacucucuccagccuuguuuuuguuuuuuuaagcagggccucaaauaucuugagguuaauaugaacuagcuaucuaguugaagcuggccuugcauuuguaauacccaugccuccacuuccuaagugccagauccacaggcaggcacacuaugcccaaguacuuagcucauuucucugaguucuuaacaccaucuaucaguaaucuauagaaacaaggauuccuguuaagacaauaugcagagaugaucacuauuaauauuuaugggcuuuguuguuguuguuguuuuugauaacuuguucaaugguuugccaaacuauagcauaaugguugcaugauucauguuuaugugcuccuccccccccucccuccuccccccccccccagccccagggagugucauuacagaguuugagcacaagagagcaguguugcccagcuggcugcuguggaccaauaaggugcaagagcagaacccagaagggcggucuggugcacuuucaaacucagccaaguugcaaguuccacuggugccuuuaaauaagaaaaauaagaaagacaacaacaacagauuuuuaauauaaaccuuuccagggcguuaaggaaagccucugucucucucaaguuggcucucuuacccuuuucucuguuccaugcaaagcugcagaccccucaccccauucugacccgugugagccugguguggccucauggucuguguuuuuacucaacucuuuacuccccauccccugcuuuuagcucucacuggcccaccuugaaacauucaaauuacuuacauucccgaguucuagcuggcagcagauauccccagaccagacaucguucccauccacccauggacugccugaaccucucugacagacaggguccauucacagacaucgcuuagcuaacaaagagaggcuuguuuuuggcagggcugcauguauacaacuccucauauagcugagauuagccuugaacuacugauucucuugccaugcaauccaagagaaucuucucaaucaagagcuugagaaguuguugaaugcuugaaaacaaacaaaaaaaacauaaaaagacccaaagauggggguggggguuaagaagaccuaaaccaccaggcuucuaagggagggaaggugccauaggccuuuaaucccagcacucuccaggcagaagcagauggaucuaugagaauugaaggccagccuggacuacauggugagaucugguucaugucugucugccucacacacacucacacacacacacacacacacacacacacucacucucucucucucucucucucucucucucucucucucucucucucucucucucucucucagugguagagucccuaugggcagcagaggcugguguucccaccagcuauguguggauggaugcaugagcgccaccacacauguguagaagucagaggacagcucugugcaguggcaccuuccucccaccuucacacgggcuccggggauuaagcacagauuacagcugaacuguggagcccuuggagucagggcaagggguugagucugcagggcuuccagcuccugcacaaucaccugccuuagauuugccccacuagacagaaagugggaaagcuuaaaggucccuggaagcaacacugacucaggguacauuuccuuguccccuuaaaagucuaugcaucuagccgggcggugguggcacacgccuuuaaucccaacacuugggaggcaaaggcaggcggauuucugaguucgaggccagccuggucuacaaagugaguuccaggacagccagggcuacacagagaaacccugucucgaaaaaccaaacaaacaaacaaaagucuaugcaucaacaauacaagcaguuguagaagagaucuuucucucucgguguacaguaacuacucaguacagcucucagcaguccuaccacugugaagacaacugcuauucacacagcgaacggggcucagacucaccaggaucgagacgagggcacaaacucgaaagguccaagucaauagcaaugggcaucuucauaucgcccuccccgcaccccgccagcaacccaucuucuccugucccgaggauagggugggaugaguauucaaccagacuuagagcaaaaaaaaaaaaaaaacaaaaacaaaaaaaaaacaaaaaaaaacaaaaaaaaacaaaaaacaaaaaccauuuugggggaaaagcuucauuuaaacugaacuugcagcaaccccguuucuucaucaccucuccuauaggacaguacaaccguguaacaacgauuuacagguggugcaaggacucuaggaguguuuaaaagcacaaauggcaugggcugguugaauaaaaucacuuuuucucuaauggacacauuuuaaaggagucuuagaacuaauuucccacaaaugucaagagacaaccacacuuaggagauggagauaacacacacacacacacacacacaauuuggaagcuuaaaagaaaaaaaaaauaaaacuuuccuccuauauuucacagaaacguuaaauauuuuaaucuaaauuuagccguugaguuuaggugacaccacuucguaaaaacaaacaaaaggugcaacaccacaaaaacuauacuauucacuauccagguuuagaauagccagugcucucuguccccaggcacagcuuacugugugggacaucuggaacuguuuaacuuuccccccacgagcuccuggagucuuuccagaauucucugcauucugaacccaccccuuauaucaaaacacgcccagcucaacucugcucguccuggcgcucaucagccaugaacccgccaggcagaaaagcugcuuagcggggcuuaacaccgaaauguaaaaggaccagccaggugacaccauuacuaugcggcucuuuggccaccgugaugcaagggugcccugauagcaucaucuaugccuucagaaagagauccucuaugagguacucugaagcuaggcguggguaacuuccuuuuaugacaugaggaagcucaccacucaggguucucccaauuguuggaaacaaacaguggaggccaccaagcaccaaaaauacugagucaacggccgcagagaccagcgcagcaccucaacucucuggacuacuguucuguccucaucacaaaccggaaccaacacugacaccgaucccagccaugugcagcauauugcucccccaccaauaauuugcauagaaaaguacauuauaagcucucuacaguaugcacaaaugcuucuguggcuuagguuuuguuuuguuuaauuaaaaaaaauguaaaucucacuggcucuuguccccccccccccccuucaaggacaccacuggcucuuccccucucucuccauuuuuucaaaaaaagacacacuuuguagcccaggcuagccucaaaccagaguuaauccucugccuccguuucccagugcugcuggauguauaggagugagccuccacacuuguauccccaauuacucugcaagauaaagaaugauguuaacuaucaguuaaccugaaaaaaaagugcgugaaugaaugaaaauagaaaaaaaugccuuaaaaauuuauuuuuaauuauguuauauguggauguuaguguauaggagugcacaugaaugcaggugucccacaaggaccggaacagaggaguaucaggagacucccuggagcugagguuaaguuaaagucacccgugagccaccugaugugggugcugggaucacaccucagguccugcucauaaccgcugauccaucucuccagcucugaaagauacuuucucuuaacucaaaaaaguaguucuggcaaguuaaguaugcauaaucucucucgugcacacaugcacgcacgcacgcaugcaggaacacacccuaguaauaaauaagaugcaaguaaguagugacucuggauuggcacaggugggagagugccccugccugguguacaugaaagcccggugccaucccuagcacugcacaaacuggaugugguagcaguguccuguaagcccagcacugggaaggagacacaggaggaccagaaauggaaggcacggaaagggugauccuugccuaaguagggaguuugaaacagcuuaggcuaggugagacccuguccuuugcugucacagcaccacugugcaucagggaaggagccacuuucucacaaucaugucgccaacaacuauuuucuaguuucuaugcccaguuaaugcuaauggaggcccagaaugacguugccacgugcuguggggcaaucccucagauccuaacucagcguguacggccuaaaccucauaucucauaugucugugugagcuggaagagaggcgauagaaaaugucuuuaagauuucuccugcuuuuagaacuaaaaacauggggcuggagagauggcucaguggcuaggagcacugacugcucuuccagagguccugaguucaauucccagaaaccacaugguggcucacaaccaucugcaacgggauccuaugcccccuucuggugugacaguguacccacauacauaaaauaaguaaagaaauuuuuaaaaagggaagaaagaaaggaagaaaaacaacagaguuccacguaguugcuauacacacuccaucaucuugccugcauuuaagaagugagagcaccaggcuccuucuccaaugcuacaaaaacucucuucccuuuuauuuaaacaagcaguuuagaagccuucacugcuuuuaagauucugaacaacugucugucugagucaggguuagucuguguagccuuggcuaagugguucuagaauuagcuuuauacaucaggcuggccucaaacucagagaucugccugccugccuuggccuccugagugcugggauggaagggucacaucaccacgcccagcucugaccuacuccucuuacccccccaccccccacaggguuucucuauauagcuguggcuguccuggaacucacuuuguagaccaggcuggccuugaacucagaaauccaccugccucugcuucccaagugcugggaugggcaugcgccaccacaccuggcucugaccaacuucuuaauggcuacuaagaauacaucuuccuuaaucaguuaacuuacaaaaaaaaacaaaaaacaaaaaacaaaaacaaaaaaaaaccucaaaaaaccaaaaaaucaaaagcauaaacacaaagacaccgagauucucuuugaagaagcugcuugcccuguagcugcccaguucuuuucuguuucucccuaguuuaucuuuuuuuuuuuuuuuuuuuuuuuuuuuuugagaugagguaucauuaaucccagccaggcuuugaauuccugauucuccuuccagauucaggcaugcuagcaaacauuuuaccaacugagcuauaccuccaaccccuugccauuaaagauuugugcucuuucuuucuuucuuucauuauucuuucauuauuuccuccuuucuuuugaggcagaguuacuccaugucacaccaggcuuccuacaccucucuauuauagaccagacuggucuugaacccauggagcgcagcuagccuccuccccgagugcugaauccugcaccagcacgucuagucucuugugcaguuucugauuacuggcaaaaaguauaaaaccaggcaacacuguccauaugcacagugugaaguauaaucuagaaagccauagauccaaccacuuaauaguaccuuaaaaacugaacgguucuucuaaauacucugccuguggcuccacugggauuacccgcuggaacccccuccuucccacaagaaacugagcacgagacaaauuaauaaaaaauggaauacacaacaccuuauacacacacacacacaaaaaaaaugccaggagagagggagaucucagaggacccauucaaaguguuguucauccauccauccauccaugcagacacccugacucgggcuggagagagggugcagcaguuaagagaauaagagaauagacaacucuuucugaggccagaaguucaguucccaacuaaaacuauaagcuguaacuauaggcucuaggggaauccaacaucucugacucuggagggcaccuguacucauacacggacugacuggcacacacauauacacauuaucacaaacaaaucuuaaagaaaacaccuaaugaacuuggaagaagaaugcuauucauuuuuuuaaaacgucuuuaauuuguagguuucauaaauguccacccuggccagcaguagaaagacuagagacaugacagaugggacagacuaugaaagagcccucggcauaaacaagcuaaacuauaggaagugagagauauuuuuagcucugcuaaacuuuugaagucauuuaaaauuccacagggagacacggcuuuggggggaagagucacacagagaaaaaauauggaagcccuggaaagucuacgccccacuuugagacaacagauuuggcagcauucaucuuaaauauuuaaaucggagccacuuuuguaaauguaaguuagcaaguggaguuuaauuuucuaagagcguaaacgggaaagugagcguaaacacgcacucuccuauauagccagucucagacuaucuaucaaacgccaaguuaguggauuugcaaaugcauucugaacgccuggcguagacugcccacuucuagaaguuggcauaacauuacaacucacacaaguagaguccuagaaaacaagcaugggaaaaauaauuauuuucacuaccuuuuuuuuuuuuuuuuuuuuuuuuuuuacuaauacuuaaauggcauuucuucccuuagguuuaguaacuauguauuauguauuaguauuauggcuaauacuaaccacguaugacagaacuaaacuaaaauauuagccugauacacgacuucacucaacguucuuauuuaaugagcucuaggaagcacugaacgcuuacaauuucucagacauaggaacuuuuaaaauuagacuagggcagguuauccacagugaaucugaugcugauucaacucgcuagcugcuguggcuucucucaacagcacagcccccacuucucuaaggggaccggauaaggcucccaaccagaugcauugucccgugagcgcuuccaggaagauuuugguuuaaauaaaaauaaaaugugcgguucauugguuuccgaggggcuauggaaugcucuccauauucaauuaucucucccuacaccggugaaaguguagggagagauaauugaaagcuaauaaaauuccagccacacggcucaccucuugagacucuucuuccagagucacaucagcaggaagaagagucaccagucuuaccugugaugguaauaguccccagcauauuuaguuacaguuuucggccucuuacggcaggaagucuccuucuccucugucuacucccggcuaaccagugagaugaaaaggaaugcaguccucagagcaucaaggaagcucuccagcccuggaggugcagcaaugcgcacuggagaagcgcuucucuggcuaauuauaggacggccccgcccacgccguaggccccgcccacagccagccagcccacaccucuguccggacuuggcugcaccacccggggaagucacgugccccauuuuacagggcuggucucugugccuggucugucgcgacccaggagaaaguuuuaagucucuggggugagccagaccccgagcaucaauauuugauccaagcggugacuucaucccuggcaccgacuccugcaucucaaacuuuuaaaauuauguaaaggcaauaacugcacagauauuaaauucuccgauuuuuaacgccauuuuuaaagguggaugaggugcaaagcggcauuuccuuuuuaaagcccauaguauguugccaaccguuuccuacacuccggucagcguaaagacccacaacucucugcgaucccaggccuuuugcaaaggguugucacaaagcgaacuaucuuuagcauuuaaccgagacaacuuucuaaaaagcagaaauaucugaccuuugggucucucuacuuuucgugguagaaaugagcuaaacauuggguugaaacuucaccaacacucuccuccuguuacaagcguauagcaaauaaaacagcugcauuaaaaauccaggcagcccaauauuucuuuucuguuaaucuugagauuguuucucuacaaagacacaaguaauaaaugagcuggaucuucaguuaggauagguccaacuggccuguuggagcgaaccaccucuccccaccccaaaauaaaagguuauauuauugcucuucucgucagacuugaaggccuuguucaugacuacuuagggaacuggagcggggagaucggugcgggaaaaagaguagacagagacaagcgacauaaaaaggggauuaaaaaaauuuuuuuugaaagaaagauuucagacauccacgaugguugcugcuucuugccaccaggaggcacaaugcaccacauuccagcccagaaagagcgaaaaagggacaacuccugggcaaucagacaaugguuacacauaucagcauuacaaagauccagaaaggcuucccagccaacgcccaaccuggcuuugagucucggcaagccaggcaaugggucuuauccugguugguuaagaucugggagcagacauuugcccucugcauucccaauaggugggguuucagacaacccagacaucucucuucccaccaucuauucccuguguguagaucauggauaagaagcccuauaugcagggucagugguccacauuaaacuagacacuucccccacagugucccaggaucccugaaggcccagggaacuaagaauacagaaccacuucccaguauucaguuguagacagcacauggcagucaccccacuccucuguggauucggguuuacauaacugcaucaccaacaccuucccuucugaccccaaauucuaacaacagcgacgccacuuugauagcuaaggggaaaauucaccagauacaaagcagacaaaacacucuuuuaagaaaaggcuaaguaaggcaagaucuuugcuuucauaacacaggugacaauacacuccucaaaugagguucaaagugaggcagcuaaggcucaaagacagcacaauggaugcugugcuagaggcugacccucccagcacacaguuaucuggaaucacuaccucccuguguaaugaagaacagggaguauauauagccgugaccaucagcaaguuccucuggggcuggccuuaaaauggaaaaccaucaaucaggacagaggcagaaggaaaggucagacagaggggucacugcaagggcaggcaccguucccuugacauuacuccuuuccacucgcgugaaaggagacguuuuagagccaggcaucaccaccuaaaacaaagaugacagaauauaugcccaucacuuggcggaagauugcuaggggguguuuucuuaaaucugcaugaucuagucaauaaauauuugccaaggucaugcuccacuuuuguugugcugaaauccacugggcgcuaaucagauauuauggccuuaggauacuuaguugagaguggcaaccccuggggauacaaggauagagcuagccuaagagaagaauagggacucccuaauguugaauacaaagaagcagcauccuggggcaaugucuggaaagagugauuugggaacucaggggugggcuccucauagcuacuguuacuuacaguucauguucauguucagaggcccaagacagcaaaggagagcuagagaugcuaaccagaaaugcuaguuaacaaggaaagauuucuacggacaucuuaagaacuuuguaauaacacagucucagcaaggaaagcagacagccaggaaugguguacuuguguaauuccaucacuguggacagaaggcuagccucagcuacauaaugacuuugaggccagccugggcuacaugagucucucccaaaaaauaaaaauuacaguaacaggacaaacaaucugaguacagcauauaacuucuuuaagauauacagagaugcacauaacagcacacaccuguaauagcagcacuuagguaauagaggaagaucaggaguucaaggcuacccucaggccagcuaaacuauuggaccacauuucaaauaagcaaagaaagaaagaaacagacaagagaugcaaauguggggcuagcgggaugguagcugagucauuaaaagaggauguuguucuugcauccagcacccaucuuuuuucucugcucccccccccccacacacacaggguuucucugucuagcccuggcuguccuggaacucacuuuguagaccaggcuggccucgaacucagagauccaccugccucugccucucaagugccaccacugcccgucaaaaaauaacucugucuuuuuuauuuuauuuuauuuuauuuuauuuucauuuuuauuuuguuuuuuugagacagggcuguguagcccugguuguccuggaacucacuauguagaccaggcuggccucgaacugagagaucugccuuccagcaccuaucuuagguggcuuacaaccauaacuauaacaaccguaacuccaguuccaggggaucugauauccucuucuguacuuuggaggaaacgcacacuuacauaugcacauauccacaaauauacacauaguuugaaaagaggggguuguugagauagcucagggguuaagaauacuggcuguucuuuggaaggaccaagguucaauuccagaaccuagaugguggcucaugaccaccuguaacuccagacucaucuuagagccuccucuggcaaugcaaccacagauauacauuaagauaaagacacacauaaaaugaaagucaagaaaaucucgacaagcagugguggcacauaccuuuuuuuuuuuuuuuuuuuuuuuaaucccagugcuuggaggggcagaggcaggcaguucgaggccagccuggucugcagagugaguuccaggacagccagggcuacacagagaaacccuguuucaaaaaacaaacaacaacaaacaaacaaaaaaccucagaagaaaagguuuuuguucauuucuuuucuuuuguugagacaggguuucuucuguguagcccuagcugcccuggaacuugcucuguagaccagcuggccuugaacucagagauccacaugucuuugccuccugagugcuggaauuaaagcacggcugggcaaaagaaaaguuguuguuguuguuguuguuuaauuaaaauaaaucuuugagauaaauguuaauaaaccaaugagaagauguucaacaucauuauccauuauaaauauguaaauuaaaaccacuucacacacccccaggaugcuaauagccaaaugacaacaauaaccaugaagaagcuguugcugguagaaagggaaacugaugugaaaagugccugggacuucuccaaagccuaacacagcugccggaugacccagcaacaaauaugcacccaagagcaugagaacacacaaucagaggagaaccuggaccauucguacugacguuaggaacaaaguguaaagcugugucuuuaaaaacaacuuuagugugcccaccaacuaacaacaggcugaaacaaguauagugggucuuacacuguaguaagugguucuguguaaggaaauagcagugauuaaaauggaguuugugggggcuggacccagguucaguucucacacccuaugaggcugugcacaacugucuauaacuucaguuccagaggaccugauaaauguccucugaagacaucaggcacgcgcauguauacacacgugcacacgcgcgcgcgcgcgcgcacacacacacacacacacacacacacacacagagguauauaugcagaccaaacacccauacacauagaagaaaacuuaaaaaucucaaccccaauccacaaaaagcuaagauaauaacauuuugucacaauggggaaaaaaugacacacagacauagcacagcuaaagaaaaccagagagaggggaggcggaucacacauggaaagggaaggcuuccccuaagccugugacucacugagagaucucggucugggggcagucagucccugcuaguaucaacuguggacguuguggucuagggcacacugcuguuugggagcagaaaaggguugccaagauccuuugggguacagggcuauuauuaccugguggcugagcaucuguggccuccaugcguaaugugcacagucuugcacaaugcacacugcaagggaccaccaacaacugcaaggugaauacacacugacuuccuaccacuuuggguuugcugguuuccugcuugucuguucugacauaccaggcuggccuugaauuccuuauuuucccaucucccaagugcagaaaugaacacacauguacaacuauaucuggcugucuguauguuuuuguuuuguuuugagacagggucuuacuguguguauagcccagguuagccucaaaucucaacuuuccuguuuuggcucccuccaugcuaagauuacagauaugggaguccccaugcccugcucucaacaguaaacuuuaaaccacuccuggauuacuuccaacacccaauagaaugcaaaccaucccaggguaacaguagccauucuggauugcuggaugucuguaccuucagaguaucccagccaaacauguuugcaaggauggacagacagacagacagacacaaacacacacacacacacacacacauacacacacacacacacacacacgauuguucagaggcuagcugauccuaugguugacugauuaaguguggaaucugcaguuccagaggauguacuauguauaccuaauaucagacuggaucucucuggguagcccuggcuguccugaacucagagaucugccugucucuacuucucaagcacaaggauuaaaggcuauacugaauaucugaagggauacugacaaguuaucgacaggauagcugguucuacugggcucugagucucugcccuaaggagcaagagcacuagcuaauugaauuuuaugguccagaugcauuggauauguuaacacagauaugguuacuuaaguuuuaaaaauccaaauaaauaaucuggagagcaugaaauuuuaaaacacuucaaaagcguagaggaaaauggaaaaaaaaaaccaaucugaaggagggcuggacgaugggcugacagcugagagugccuacugcucccucugaggacccaggcuucacugccagcucccauaucagacagcuaacuagacaccuguagcuugcacagaccuguuugucucugccuccugaaugcugggauuaaaggugggagccaaccccauaccuauuucuuuagagugaaagcggagagugaauauuuugauggagucccaaaugcuauguaacauguguguuuuuagaaauuguuuguuuagugggauauugugugcuuuguauggguuuguguaugugugugcaccuaccuguguguguguaggucagaggucagugucugcugucuucacuguucucuaccuuguuucugagacaaugaccucggagccugucauuucagcuagaccucaggaucugucuguuucuacccucccagugcugggauuauagacaagagccaugagagccagcuuuuaugucggggcuggagauccucacugugcuucucgcagagcaagcacgggacaaugggagccauugucccuacccauuguccucaagucuuaaucaagaggaguggggaggagggauaaucugaagcuacagacucaaaagaaauaauagugauuacauacauggcacucacugauucucugugacagcaauaagaaugagagccccaaaccacacaauagccagccucaaaccuucaaguaaccacguuggaaaacacaaaggaaaaagcugaggauuugccauauauacauacauacauacauacauacauacauacauauauauauauauacacacacauacauacaauacacacacacauaugcaugcuuagucaucagggaguagaacuauuugagaaggacuaggagguguggcuuuacuggaguggguguggccuugcuagaggaagugugacaguaggagugggcuugguguuuucaaaagccuggauaguuucacacauccugcccaguauuucucucccucccccucucugucuucagaucaggauguaacuauaagcuacugcuccagcaccaggagugccaccauggccccuccaugcuccugccaugucaauaaaggacuaauccucugaaccuguaagcgagcgcccgcccaguuaaaugauuucuuuauaauaguugguugaccaugcugucucugcacagcaauagagcagugacugagacaaguggacaaugaacuuccccaggugagcugucugcauuucuagcugacagguuaucaaguggaaauggauccuggagauuguuuucugugagcuucgggaggcugaagucuccaggaagcacacaggggaugucuggauaagggcagguuggacagcaguguauccaucaugcugacccugauggaaucucaaugugucugaacggaaauuaucucagcgaggggaaacucagagccaagauuugacagucaugaugaagugauacacuucuuuaaaaguucauucacugacuaucucaguuggcuugggcaaugacacaaagcaccacaaaccuggcacacagcucccggacacccagggcucauucucaucacucugaaggccagaggucugcaguuagcauucugucauggugaggaccuggugagguuggacacucuugacugauuuuggggauauuuuguuuguguuuguacuagggauugcuuagggccuagugcauucuagccaaguguccugaaaagucaccucuaggaguuggcaagauggcucaggggguaaaaaaaaaaaaaaaaggaacucccugccaaggcugaugacuuuaguuagaucccuguaccccacuugguggagagaccugacugcuauaaauugcuccagagaaagaggcaggggguggagggagagaggggagagaggcuaaauguaauaacaauaacuuuuuuuuuuaauugccauaucuggggcuggaaaaauggcucagcaguuaagagcauuagcugcucuugcagaggaccuggguuagguucccagcacccacaugguaaacagacauguaggcaaaauaccuguacaccuaaaauaaaauaaaauuauauauauuuuuuuaauuuaaaaggcagggucucuugccgggcaugguggugcacuccuuuaaucccagcacuugggaggcaaaggcaggaggauuucugaguucgaggccagccuggucuacaaaauaaguuccaggacagccaagacuacacagagaaacccugucucgaaaaacaaaaaacaaacaaacaaaggcagggucucucacuggccuagaacacaccaaguagaguagacugacuagccaccaaguuccagggacccucuuaccuuggccucccuggcaucaggauuucaagcaugccccauaccacacuuggcuuuuuaaauauagguucugggggauuguacuggaguccacaggcauguuuaccaacugaacuaucuccccagcccuuuuguuaguuuagucuuugaauaaugucuuaguuaggguuuuaccacugugaagagacaccaugaccaaggcaacucuuauaaaggacaacauauaugugggucuggcuuaggaguucagagguucaguccauuaccaucaaggugggagcauggcagcaucaggcagucauggcaugguguaggaggagcugagaguucuauaucuucaucugaaggcugcuaggagaaaacugacuuccaggcagcuaggaugaggguuuugaagcccacgcccacaguaacgcaccuucuccaacaaggccacaccuaguagugccacucccuaggccaagcauauucaaacuguuacaaacuguaucccaggcuagccuugaacucaauauauaguagaagaggaucuugaacugguguuccugauuuuaccucucaagugcuggggguugcagccccaugccuggcuuuacucuuacauuuuaaagagagugagagauaagcuuaaaaaugagaacuaguacuagugagguccaguuaguuuuggcaggcuuccaccaggcacauuccucuugaaacauacguaaguccugguguuuuuucuuucaaugcaaggcagcuucuuuucucuggagauauuagggaagaugaaagcggcacgugauugauguuugcaaauacuuaagaggacugccuucggaaagggaggugagugugcucugcggagcuuagaaguuagcccuggagacaggcagauuuucaggccuccuuuuauggaggaaaaaaaccaaaacaaaacaaaaaaccuccccagaagcagcagccacagcgggcagggaccugacacaucagcccugugacucucuucucucuucuccuuaggcuucuuggucccaaauuugacaaucacaggauguuaagcuaacugcccccuuccccuccacccucauuuuagagauaaggacucacaaagugugaguuggcccugaaugggcuaauguggcugagggugaccuugaacaucugacccuuuuucauuaucuccugugccaccauaccccaauuuaauguaguuccagggagagaacccagagcuuugugcaugcuaaguaaacauuacaacugggccacagcccuaggcucugaagagaaaaggccuuuaaauagccaauuaagccaaguaugguggcucuaccuagagagucugagacuagccuggguuauagaacaaauucaaggccagcaugggcaacucagggaaucuuuaaaaauaaaauauaacauaaaaaugauuaaacaaaggguuuaaaaaugaggucacuuaaggugggcucuaaaccaaaaaccaucugguauccucaugagaagaaauuuggacaauuaaagacacccauggauguagaaaggaaagacaauguagggauagcaagacagcagucaucuacaagccaaggagagaccucaggaguuguugaaaccgcucagacuaugggaauaauaaaugucugucucuacaucacagacuaugggaaggauaaaugucugucguuacgucaucugcucuagaguuuuauucuagcggccccgacggacucguacagugaggcaauggcuacacacuuggcacuuuucuaaacaugacacaccuguguuacgauacagcaaagcuggaaggcaagauagcucagccaaaacaaagaaaaaccaaaaaaaaaaaaucccaaaaaugcuugcucuuaagccuggugaccuaaggucgaucccucagacucacagggugaaaaaaagaauaucaacugcagugaacuccaugagcacauaaacacacacacacagaaagacagagagagagagagagagagagagagacagacagagagacagacagaaagagagguaauuuuaaaauguuaaagauaccuuaaagcagccaugcacagugaucugucuuuaaucccagcacucaccugaauaacauauauauucuauacagacauuugaguagcaauagcagucagaaaaaaccucaaaguauaagcacacauggggaggggggauguuuguuuguuuguuuguuuguuuguuuguuuuugagcccugguuggccugaagcucacuaccaagcuggcuucagauggaaaacaauuuucagucgucacauauugauugcacaugucugcagguuuccuguguguaugugugggugugcacguggaggacaacguuguagagucaguucucucccucgacuucucugccaacuccagggaaucgaaggcaggucgcuaggcuugugcaacaauuaauugcauuuaccugcucaaccaucuugcuugcccagaggcugcgugcuaagcuaagagaaugcauuucucugccuaacugcugugccuagguugaugaccacgccacaggguggugugauuggaggauaccacaggccuucaggaauagacuguacugggggaccuuaaguuauuggggacauacuccuggcauggauuauaguacaacccccuuccugcuccuuuugcuucccagcaggagauuagcaucucgucccauuacaugcucugguccuggcuauuuggcacacccaccuaccugagaccaaagcaguggacggcccaggcuuggacugaggccucuaaagcaguaagccaagaugauugguuucuuucucuuggucauuuaacauccuuagguauuucuucacugugucagaaagucacucagacacuugcuguacugaccccuacaccauccucacaaagaacgugacuaaacggaguggugaacggacuacauaaaaccauagccaucuguacuuggcacuucuagaauuagcuagcugacaggaagcaauggcuuuugucaacaucauuuccauccacucuucuuucccaguccuagccuuccaggaacgcagcagcacuaacacacuagagauccacaugacaccuuguggcgacauucguuuauaaagccauuaaccuugcuccucauacccaaaugccucugaggcgagauaguauuggauacaauguccccucacgaaccuuuuauccaauuacgauuaaaacuucaaauccagaaaaaugacuuuuaguaucagauuaaggaaaaccucugagguaauuuauaaauaggcauaaugacauuuuaagcaccuguccaaggcucaggugucugcaugagcuaauccucugugcuucuaaggcccaaaggagugacacugaugagucagccuucagaggaugcucauuuuacagacagaaauggauuccacagauauauggagauguaucuaaaugaaggccgucugcaugccugugugcauaugugcgugggugcgugugcgcaugcgcgugugugcgugagugugugcgugugcgguuaagagaaaguagaagcagaguacagugacaugcaccuguaaucucagcacuuaggaagcugaggcaggaggauugccuggacuauuucaacaccagcaggagugaaucuaaaugaguucccaggguggcacaccuaaagacuuuccccggaguucaaagcuuaguucacguuagugcucuauaguuuucaaaacaucaacgagacaggacggagcuugaggaaacaccacacaacauuauuguaucugaaacacacagugugugcuguguguggggaggaggcgcuccugggucuacaggacauuucuaggaauccuuguucacuuauggauaggucaggaugguauugcaggccuccaggcaagauaccagccagcaguagacacccgagggccagcugcacacucugaaagggaucuagcuuuguuaacaccuaugcaacagaagggaguguggccaagacucacaaaacuggggcccucacagacauggugcaugcaccuguaagaccagcauugccaggaaacgacaugaagacuaccgggaguuugaggcaauccugggcuacauagagagacucuaacaaaaauaaagcaaaacagauugacauacugaaccaaaggaauggagcugucaugaacucucccuucaccagguccccauucccuggcucuguucucuaucaaggaggcgguaagagagacaucagaugucaggugcuaacaacugaaaccaagagacacagaaggaagaauaacaauaggguggcaggcaggucuuccuaaaacauacaagauuauaucacauguuaaauuggaaaaggaggcaaaaaucauaaaauauuucuucugaguagggaaaccaccuuuaucugaaaagcaagugugugugugugugugugggggggggugucuuuguuuacuaggagcuagggcaggccuucgcgugccuacucuccagaucaaguuguuauuccucaaacgaggaagaaggaucacuuuugauuccagcguagaugaucuguaagggaacagacucacugggagagugguaauuauucaggucaccuuugguuuuuccauaucccaaagguacucagcauuaggaaggggaaagcucagauucaauaaaacaaguaucaauaaaagcaccauuagcgaaauguauucuccacaaugcagcaaauucagccauuaaauaauugaguuaccaguccuccacuuauguuaucccugagggauagcauggagguauagaaaaguggauucuugugaaauugagaacuagacacucuagacaacucugcuuuaaccagugcccuuagggauggaaggggugagugacaagcucagaccauguaacggggacucauucccugcaugcagccucuuacugcucucugaugaacgugacacucacugguucaccuggcuaauacuuucagaguggaugaguuccacaggaacaaguaccaaccacaaagcagggagggacaaauaccagugcaaauucccucaggucagggugcgcaaaugcuguaauaccuacaugaagacaauaacugaaaacaaggacagagcaccacuguucuuucacucacacaaaugugaccggaaagauugaaaugucguuuuuuguuacauagacuccgcaaaccacagaaacacccagacaucccugccuugugaaggaaacacccaaauauacugagaucugaggcagugcugggcgacuugugugagguuccuuagacauuuuguuuagcaacggguuauaguagcauccacaguaauaggauguuuaucuguuugaggaacaguaguaaaagaugcucagagagaaagccaagcaguuuuaaucagaagauaaauugacgaauccccggaagaggaugcggagacugacucugaaagggaagggaauugcagugauuuuuuuuuuucacugcacauaaacauuugcauucaaacucuaaacauguauggccugaagaugucccuggggcuggcuggcaaugugucuaaguggguaaaagaguucaccaugcaagccugaggacccuaagauuuaccucuggaagccaugagaaagaaagguagacauggugguggccauuggugaucccagcauuccuaaagaugcaaugagaggcagaggcagaagaugcacccagauggaugugggccaaguagccuggaggaugcaguacaguagccaaagccucaaauaagagcugacucaaaaaaacugucuucuaaaaaaaaaaaaaaaaaaaaaaaaaaaaaaagcuggguguggugguacacaccuuuaaucccaacacuugggaggcagaggcaggaggauuucugaguucgaggccagccuggucuacagagugaguuccaggacagccagggcuauauagagaaauccugucucgaaaaaccaaaaaaacccaaaccaaaccaaacaaaacaaaaaaagucucuaagaaggagagagugagggcagaaagcacccauguguuaggagcggguguggcggcagucccaaaggcgccagggacuguagcuaagucguaugacuugcaccugacuuccucauauaagccacaaacaucuugagagcugcacaggugcaccaggauaccggugaauccaguuugauggaaauaugccccugcugcccugauuagcugaagcugugugccuggugaggcggcguggccugcuguguguggaugagaguauaaaaggagugagaggcccaggguucgggggagauauaaacaagaagaaucaggacugaauaaacugcuguuagaaggacugguggucgugucguucuugcuggucgagagcggacgugacacccauggggaaaaaaagauuccaauauaucugaauuauugauauauauuuuguuuuucgaggcaggguuucucugugcaguccuggcuguccuggaacucacucuguagaccaggcuggccuuaaacucagaaauccaccugccuuuaccucccaaguguggggauugcagacaugcaccaccacugcccggccuuauugauauuucuuaauuucagaaaaagcaagcaaguuauaaugggaaaauguucacuucugucugucuaaaacuguugucagcgacuucuugaguuguuaaagucugcaggagcuagaauuaccuaggagacaagccuccaggcaccccuagaaagauuuuucuagauuaggucagccuaaucuaggccgcugaccuuuccuagaaggguuaucuucaguagguuaagugagaugcaagacccacccucaaaguagacgccauucccugugcugaauccuggucugcaauaaaagagcuaauugaacauuguguucauugcucccugcuuccugacugcagacgcuaugugaguauccacggcaagcucacauaaccugucugcuguggggggaccugucuguuguggggggacuguaccuugaacuguaagccagaggaaaccuugucuuaaacugcucgucagaguauuuuagcacaacagugaaaucgacuauagaaaauuaguaucagaagugcccugggacuuacuauguagccuaggcuggccuugaacuuugaagcaauccuucugccucagccuccgaaauucuggcauuauaggcagguauaaauuaccauaaccacagaucauuucucuucugccuuugguggugcugggagucaaucccagagccccgagcaugcuauacaaauauucuaucacugagcuacgcccauagccucauaaguagcaccugcugcuuuaaaguaaccguuuggcaagaaggcugcuugaaucagaggguaaguaaaaacacuugcugugggagcaagaggaugggaauuugacuccccaggacccacgugaaaggcaggcucagcugugaggucagguaaccccggcaucggaggugaggaucagagacagaugcccugucuccagacagagcuggcugcugaaaaccaugagcuucugcuguugugaggggauccagucucuaaaaacaaggugugaggagggggcaaggcgcucucaccuggccuccacaugcaugcaugugcuugcgcacguguauauaauuuuccuaaaggcgucuaacaggggucaaggccccugucgugaagccugaugacccacguuuaaucacuagaacuccuaaggcagaagcaacucccauaaguugucuucugacuuuuacauauauacacacacacacacacacacacacacacacacuccacaggcuuaacacuaauaucaauaugaaaaaaaugcugaugaagaauuuaacaugaggauuccaccugcauuaacacagccaggcugggaauucugauagccaggcagauaagagcaaaagcaaguuggggaggacaggguuuauucggcuuacacuuacacauugcuguugaucaccaaagaaagucaggacuggaacucaagcaggucagaaaacaggagcugaugcagaggccauggagggauguuccuuauuggcuugcucagcuuucuuucuuucuuuuuuuuuuuuuuuuuuuuuuuucuuucgagacaggguuucucuguauagcccuggcuguccuggaacucacuuuguagaccaggcuggccuccaacucagaaauccuccugccuuugccucccgagugcugggauuaaaagcgugcgccacuacgcccggcuucagcuugcuuucuuauagaaccuaggacuacaguccagggguggcaucaccuacaaugggcccucccccccugaucacuaauugagaaaaugccuuacagcuggaucucauggaggcauuuccucaagugaggcuccuuucucugugauaacuccagccugugucaaguugacacacaaaaccagucaguacaguggccucuacaguccucucagaggauggcuaccguucccagcaguugggcuuuucucggggucuucugaaggaagucuguuccucuccacucucucaguucucggcauucggugugugcccaggcuucccggaccagccaugguuaacugccugagucugcucagggaagccaugcaaugcagucacagguggggacaggauggcuuuucauagaagcugguguuuagccaugugcugaaaugucugagaaaccacgucuggggaaaagaagacagcaaacagcaagccuccacgagacaagucacagaugacaagggacaccaugcuuuccaggaugucaugggaugagugccuggccccgaucccaaauaucuagccuacacauuguacgaaaaucacucauggacuugcaauacugcacaguggaaaagacuugaagucaaacauuggguuucauacaauagaaggugaaaacugacuugugugugcaccacacacacacacacacacacacacacacacuaaauaauuaaaaauaagaacagucggagucaggguggguggcaagauggcuugccccugguuccucucaccaaaucugauaaccugaguucaagccccagaaccaacaugguagaaagagagccaauucuugccaaguuguccccugaccacuacaagcacacucagaccucugaacacucacagauaagugaguaugugaacacacauccacacacacucacagcaaagaaauuaaaauauagcagauuuaaaaaaaacaaacaaacaaacaaaaaaaaaaacaagacaaaacaccucacucagacugucuuuuuucugccacauuucaaagaucucaaauuguccacaaaauccuccacaaaccagugguuuggcucccuuuuaaccagccccaguguuuucugucuggguuuguauucaggcuuugcuacuacaacccaauguugucaucuauaaaauucacucuugagaaacaugaaaucaagucacacacacacacaaaucccucaugacguuuuaaguaagcuugugaucucgcgcugagucacauucucagcuaugcugggccacgaagcaaagugaucagcagaugaagcucaaaggaaaccucuggugucacacuuucuccaggcugcuucuauaugugccccacauggggacagugcagugguuaauagucaauuuagaauacuaauaaccuagcuuugagucccuagaagaguaccuagcccacagacauugccauaacuacugacaaugaggaugaaguuuagggaagcuguggugguuugaauaugcuuggcccaugggaaguggcacuauuuggagguguggucuuauuaaaauagguauagccuuguuagaguggguguggccuuguugguggaagugugucacuguggagaugggcuuuaaguucuauacucaaacucugcacaguguagaagagagccucuucauggcugucugaggaagacaaaguuuccuccuguuugucuucgaaucaagauauagaacucucagcuccuucuccagcaccacgucugccugcacaccaccaugcuuccuaccaugaugauaauagacuagacuucuaaaacuguaagccagccccauuuaaauguucucauuaauaagaguugccuuggucaaagauagacacuggcaauugucuagaaucuacaggacccugacuuccaacccuaacaccacagggaagugaucagacaucaaguguuggcucuggauggucucgguucugcuaaaaacccauuucauuucuuacaguacuaugcauaaaaccugggccuugcacacuauggauaaaaagugcuacaaacacugggcuucguccccuaggccuuauggugacauaucugauuccagcuuccucagguguuagugcuacccuugaacucagggagaugcuccacccgaacucugagcagcucccaucucuugcaaaauucuuagguaaucaccaagcagccucuucuucgucuuauguuuuacuuauuuaucuucuacuggcugccuucucaaguccccuguugggaagaaucagaaguagaaaaccugaauaaauggucucugaaguaccugagccacagugacuucaaugggaugaaaaauaaaaauaauucauuggacagcuguagagauggcucaggcaguaaaguuccagaauuugauccccagagcccaugaagagagccaggccacgguggcaugagcguggucucuuagugcuagagaggcagaucccuguagaugcuguucaaacagccaagccuuuuggaaacgcuucggccauugagagauucugucucaaaaauccaaaguagauggccccugaguaaugacgcagagcuuguccucuggcuuccuccugcacacacgcaccuguacacacaaacuuacacacacagacacaccagccacugucuggcucaacucagaaaugaacauggagaggacaaaggguucuccucgggaauuugauuuggguccacgccagcugucugguggggauuauuugaaagucucacacucagucggggaaauacuucaucugugagacuauguaugcauuucuaacuuuauauggugccuguggugauauauaaagaucaguucuucccaccaacuucaaagcagcuccuggcuugaugcagcacuguggggguauaggagaaacggguuccauguguucagaggaucuuauccagcgaggcaaugcccagugcuuucaucugugccuuaucuauauuacacagaagagccaaguuacuacauggaauauacccuuuaaaacuacauuuauauauguauauaucuguguguguguguauguuuuaaguguguguguguguguguauguuuuaaguguguguguauguuuuaaguguguguguguauguauguuuuaaguguguguguauguuuuaaguguguguguguauguauguuuuaaguguguguguauguuuuaaguguguauguauguuuuaaguguguguguguguguauguuuuaaguguguauguauguuuuaaguguguauguauguuuuaaguguguguguauguguauguuuuaaguguguauguauguuuuaaguguguauguauguuuuaaguguguguguguauguuuuaaguguguguguauguuuuaaguguguguguguguguauguuuuaaguguguauguauguuuuaaguguguguguaugugcguguguguagaguguauagggcagagaggacaacuuucaggaaccacuucuuuccuucuaucgugcaaguccugaaaacaacucagacugcaagccucaacggcaaucaccuguaccugcugaguaucucaauggcuccucuauauccugaauugaauggcaaauggccccagcacuacugccccaugaacaaacauggaagcaacacuuuggcuaaagaugcagcagcccauugucccuucuuccccacugcacucaagagcuagaugugacuucccugaucacagcugagggaaggagauauauguacaugccaggagaucugugcgugugacacaggcaucuuuggaaugaugcuaaacugucgcuuucauuuuuaguuggaucagguguuggacccucacuuuuauaaagcaagcaucuuucuaaugagaauucauacuuaacaucaucacucaagaaugagggucugggcggugguggcacgcaccuuuaaucccagcacuugggagacagaggcaggcagauuucugaguucaaggccagccuggucuacagaguaaguuccaggacagccagggcuacacagagaaacccugucucgaaaaaccaaaaaaaaaaaaaaaaaaaaaaaaaaaaaaaaaaaaaagaaugacgaacaaugauuuaaaaaccaaaaaaacuccaagagaagaccauugaagagagugugaugcuaacaccggaguacaagggcuacccagacugcauguuaaacaucuccugagaccagcugacuguaucguuggcauuaugcacugugagucaguacaguacgacaggguuuucuguugacagcaugugacaacccaguucacugcaagugcagucuacccuccagcucccaauguccugccaaagccagucuggccugcaaggacggcuuaccaucuucaacagugacuucuuccucuugcccauccuggcuuuccucuuggacguggacaucuucuuguucagcuacaccauugacggcagacagcugaccauucuucugugggagcuggggggaggagggagacaaagccacguaaacaugagaucagucacauacuguccccaccccaccccagugcaaguuaaaaguaaugccuugacuuccgguguauaaacuaugaaauggcggggggcggggcggcggggaaccugaagaugaaaguucuagaagauucaguaaccauauagaauaccugauguucugucaccaaaagauugacccuugcaugugcagugugugcacaaguccaugcacucauuccucuguccauuagcuauuuaagagccuguuucagaaacugcaaugcagcacuugggugagucucagcccugagcuuacauccuagcauagcacagaagcuaaacuuaccuugucccuuccaucuuauucuugugaugcugggggcuggagauccaggaccuugauacgcuagggaagaaaucuaucaucugugguccuagaaguguguguguguguguguguguguguuacuauaaaauaguaauucaacgacucuggcuuuuaauaggccacacccacucuuggauguauuccuugagcaucucuuccuacuaacagcuauuccuaaaucuguuaaaaaugccuuuuaguaaggcccaacccuugggcuggaaaguuggcucuguagaacacauagcucuugcugccaagucggacggccugaguuugaucucugguagaaggagacucaauuccccacaaacuauccuuugaccuccaugugugcaccacagcacucaugcauacacaugugccagcacacaccaauaaauguuaaaauuuaaaagaaggaagggauggagaugacuuagggcuaagaacacuggcugcucuuacagaggcccauguuugcuucgcagcaaccacaugggugggggacaaacagccauccagaaugugugcccuccuccaggaggguacaaggcacacacggugcacauaaauacaugcaggcagaacauucacuuaccuaaaggaaggacauuuauuuuaaaaauuauaagauccaacucagcuucuuaaaaacauuuaaaacuaaacaaguaaaaccacauuucuuuguggccagauacagguuaggaaaaauaacugagcuuuauaaguaagguguccuuaaguuagagcuucaaacuuguauguagauggguguuuugccccgcaucuauguauauguacaugucugugccauguauacauagagugcccaagaaggacaaaagaggacaucagauccccuggaacuggaggcagagaugggugcugggaaucaaaccuggguccucuggaagaacagccagugcacgcuuuuaauaucucuccauccuucaaaucugcugaucaaacacaguuacugaguggcaguuauaaagagugccacgaacugacugcucuucagagguccugaguucaauucccagcaaccacaugguggcucaugaccaucuguaauagaaucugaugcccucuucuggugugccugagggcagcuacuccacucauauacauaaaauaaauaaugaauaauuuaaaaaaaaaagcaccaugaagcaauuaugcaaagcaagugguagcaguagauagcuccaggcugugguugggguguccagggcuuuaucaaggagguagauagagcugaggguucuccuagaaaggacugugugagaacagaggacacagcgacgggagagggucaguccauaaagaacuugccuuagguuaacuaagaccugaauuuguuuggauccccagacccuaugugaaaguguggugacaugugucuguaaacccagagaugucaagaggggaaauggagacacagagauucuuggagcucaugggccagcuagccuggucacuuggugacauucgaggacaaugagaggccuugacucagacagaaggugaaaggugacugacugaggcuguuccacauauccgccaugcgcaugugcaugugcacacacacacagaaaagaaagagagaagaggggcuagucacaaacucagcuaaccccaugcugucacugcucauggggcaguggauagcuccagacaaagagguacugcucuuucuggaaaguucuguggccuuuagacuaguguacggaucucaccgugcaauucucuauucccagcaaagcccuucccccucuugcauuuccucugaaguagcaccacacacggacacugcagacagagcagucagcuucaaaaugcccaugcugaguccaguuauuagacgagaugcucggauuacaguucugcuucaaggguucacuuaccaaaauaugaaagaugggaauuuuaaaugaaacaaaguuagaggagagauggugucucaucaggaaaaaaaaaaaaaacaaaaacgccagcacauuuuaaacugaauagugcagggcugggccgggguuggaucggauugaguuagcagucugaagggcagggggauggggagaccgaaucacauguuaugaugaaugugugguaauugaaagaaucuuuggcucuguuuugaugugcuaguggugaugguacaaaucuguaaucuaggguacuugggagugggggaugaggcaggagaauuggggguucaaaaccagccuaggcuccaugagacauugcaagcaccaaaagaaauuagacagagaucucaggaaggaugcagugaaagauguaucugugaacacacacacacacacacacacacacacacacgaauccauggaggcuggguuuacuagggcauaucuuccccaaaugcucuccaguuuaguaaggucuuguacuaaacccaggucaccugucuuugcuguccacgcgugcuuaauaaaacccacuuuuaaugcuguaaacaauagguuaauuguaaacucuaaacaaacaacgguucucaucuucuucuucuucuuccuccuucuuuaauauuuuggcuuguuuuuguuuuuauguagcccuggcuggccuggaaugcuccaauagauagaccaggcuggccucaaacgcaagagauccaucuaccugcccaaguacuagaauuaaagacauagaccgcuaugccuagcucauacauuuauuuauuagcaugugccuuaacuuuuucucaaaaucacacguaugugucuggguauaauauauguuugaguguaggugccuucaggucccccgaggcuucagauccccugaugcuggaguuccaggugguucugagcagcccccugcaugggugcuugaagccaaacuuggcuccuuugcaaaagcaguguauucacuuagccacucaacuaccccuccaaaaccaauaccagcaugugcuuuuuuuccccccacaaccacaaaacuggagcaucugcacugguccccguacugagaagagcuccucacuaacucuuccuauccaucauccuuagccgggaucuccuuuccugggacucucacaggaccucugaagacaggauuuacacuccgcucagggcaggaugagaugugaauggacccagaugacgucagcugguguccaguucagggagaaagguaauuuugaaauucaagguuuucaagaaagaaggugauccagcuauuuuucucucuggagcuuucucacucagcuuuacccacacaucuuggacuuaaguauuagggauacauuuauuucuuuugagacaaaaaauggaauagagagacacagcccucaccccauaagcacagugaguaccagaaacccaaucuccccacuggauuugcgauucaaaaugugaagacgccuccucugacuaaaucaaaacccuaaguguuuuggagcucauauccucugggcaggucagccagaguuuaucccaguaaaguauuaccauguuacaacaaagcaacacuaaaauaaucaaaccucucaaauguuuccaacaacagccuuccucuaggaacacccggggauauucaaggcaguuguaagacaucugagagugaggaccgggcaucucucucuucccuucguucauuauaaaacugucuagagcuugcccugaauucucuguguggaauaugaauuucuuaaacaaugaacaaaauccaugauguccugccaucuuucaggauggugaggauggaggagaggcugguagaagagccacuuccucugcaggagccaucuuccuaucuuacguucuucccgauuggcccacacagcuggggaugacccagcaucuggaacauauagaggaggcagcuccaacuccuguaacuugcccuaccuaugauaccagaaaucauguguacaaauaaucagaaugggugugggggggggggggggacugggaucagccaggcuugguggcacacaccuuuaaucccagcguucagaaggcaaaggcaggaggaucucugauuuggaagccagccugaucuagagugaacacagagucaguuuaagaucaaccagagcuacacaagagaaacugugccucagaggaaaagauuaucucaaccauuauauuauaguugagucugaagugccaauauuuauugucuucaucauccuuagcauauuaauguccucaaucaagccauucaccaaaauaccaaccaaggcugggauauaggcccauggacaaagcaaucucuuauaggacagucccauguuugaucaucagcaacacaugcaccccuagaauaccaccugacacauguuaagauccuaauaagucaacuauaaaauucuugauacguuauguguugucaacaaauggggucuccugacaauuccuugucaagcguauguucugugggcagagcacuccggggacucgugcauguguuauucaugcuuuggauccaaggaggaaucuggcgacuggggagaaaccacagucucuuucuuuuuuuuuuuuuuuuuuuuuuuuuuugcuggucugggaaagaaagcaaggaagagccacagagguugauguuaaggaggagaauggccugaaguuuuguuucuaucacuugguuguuugggggagggggacauaugacuuauccauuguucuauaaaauagcaugaccagaaacaacuugaggaagaguuaauuuugccauaugguuccuuccacaugguuucaagcagcaggcaagaagcuaaggguucccaucuuugaccucaagcguuaagagaaagaucucuggaaguaaggcugucuccucucgaguccccuccuagugaugcacuucuuccugcaaggccacaacuccuaaaccuacccaaaaugcuaacaacuggagaccaagcauugagaugccgcagccagccaaugggggacauuucacauucaaaccacugcaggagguuuucaaucagacugcaugggguaaguaguacugaggucaagcucucauccccccaggcucugaaaccucaccucagcucauuuucccaauuauaaaccaagaccuaauacacuuuucuguuuuuagacugucuggaauuccaacgaauaguaucugggacauucucuaagucauaaaagcacacacugagccgggcuguaguggugcacgccuucagucccagcacuuggguggcagaggcagguggauuucugaguuggaggccagccuggucuacagagugaguuccaggacagccagagcuauacagagaaacccugucucgaaaaaccaaaagaaaaaaaaaaaaaaaaaaaaaaaaaaagcacacacaggagacccuuuauguccugguccaguccauuuguuuaaaugaggacauaugcucuaggccagucuuuucuggcucuuguaucacacugaggccaucauuucugaauuguccucuuguauugacaaaacaacauuagcaaauaaacugacauauuuaagauguuacugucaaauauucugccagaacaaugaaaaaaacuagagugccuuuagauuuuccagaguuggaagaaauguuuucuuuagggaauugucucagcauuuuggcgacaaugaaaccuggcucucugguagcauuggccacccuagcacuggggagacagaggcaggaggauuaaaguuugaggccaagcugagcuaguauagcaagaauuucuuuaaaaaaaaauaauaauaauugggggcugaaaagauagcuuagugagugguuaaguuguucuugcagaggaccgaguuugauuacuagcacccacauggcagcucacaaccauccauaacugcaguuccaagcgauucaacgaucccuucaucucugcagucaccagucgugcacaugauuuacauagacauauauacacaagcaagcaaaacacucauacaaauaaacuuuuuaagucuaagaagcuuucuagcuaguuaaucagaugucaauacaggggauuggaaagacucagauuaagaacucuuccagacccuaguuugguucucagcaccuucuuuaggcaccucauuauaucuccagcucuaaaggaucugacuuauaacuucuaugggcuucauacacauguggcacguacacgugcgcacacauacuuacauacauacauacauacacacacacacacacacaaaucuuagaaaacaauccuucaguauagauaagaaauuuucaauuuuuuuucuaguuuaaacagaagaggggcuggagagauggcuucugcuuuucugaaggcccugaguucaauccccagcaaccacauggugcuucacaaccauguguagugggaucugaugcucucuucuggugugucugaagacacaguguacucauauacauaaaauaaauaaacuugggggggagagauggagagagagagagggaagagagcagaagaacuaaggagauagcugaguugguggugguguuggggaggcacaguagguggauuucugcaguuagucauaccuaacuggugaguuccaugccaaggagagagagggagggagggagggagggacaaugccucaaagcaaaaagagcauguacuacacacacacacacacacacacacacacuaguguagcuuauugggcaauggcacuugacacuaagcgagccaagaauaagacuuaaaaugcaaagaagcaauuuaaaaauauagugcagcgagugaucaagcccuugguuaugguacaauuuuauguauuuaucuauuuauuuauuuauuuauuuauuuauuuauuuauuuauuuauuuagaggcaggguuucucuguguaguccuggcuguccucgaacucguggugcaauucuuaaaguaagagacauguauuucucuucaguacauuuaaagaaaacuaaccuucaggcaaucagaaaggccaugaggagcgcuccuaacuagcaagagcuuucaaagacaauaaacggacugcuuauuagguuucaggggauuacggcgcugcugagccaaaagcucucuccaaccacaugaaacugagaagaauccaucaggagacuccagugaccuccagagagaucugggaaguccuuaucucaggcaacugagauaaaacagucacuccagagcauggaguggccccaccacacacacacucagcaggauacagaagauaccuccacugagcuuucuauagaaucagguuguuuccuuccccucccauacagcagaaccagaagcaacagaaagccuccuuagugacuggcuuuaauuugaaguucagaagacaggauacuuacauugcacaggaacauccuggucugcaacccucccauuucagagccuccaguucuaggaucucacuuagaaccagugguacuguccgccaucacccaaagaccagaguacaagcguacacaaaucgccacuuagcccuuuaaaugcuugauuggcauaggaaaaacagauguaaauuuaaucucagugugaaauucugauuuucagggagcugcagagauggcucagcaguuaagacuaccugugcuuuuuuuucaaaggacuagucuagucccagccccuaguugggugacucacaaucacuuagcacucccagucucaaaggauuugcucuccauuggcacccacacauguugguacacacaccaccaccaccaccaccaccaccaccaccaccaccaccacacaaugaaaaaaaaaaaaacaaaacuuucugaaaaugaaaauucuaaaaaaaaaaaaaaaguguaucaaaagauggccuagucggccaucacuggaaagagaggcccauuggacuugcaaacuuuauaugccccaguacaggggaauaccagggccaaaaagggggagugggugggcaggggaguggggguggguggauaugggggacuucugguauagcauuggaaauguaaaugaguuaaauaccuaauaaaaaauggaaaaaaaaaaaagugaaaauucagauuuucauagaagaaagaaacuucuccgaugcuuuugaccagagucacauuuauuaucugaggaaggaucugggaugcuaucugcccagaauacaagcuccggccagucagugccccuugaugcagcuaccuucuuuggcaagucucuauggcaacucucuauggaugcucgaccuucguguucuuguaauuuuaaguaaaauucaugagaaucucuuaacauaauuucaggaggaagaccucagcuuuaucuuuaucaugagaaaaaguguuccaagacagccacugaaaugaccaguucgcuuuuagugggcacaauucgcuuucucuucagccaaacacuucaaauauuccaacuuuugaaaguccuagagaguaauuaacauaauauuguucaugcaaacagacccugagguggacucaucuaauuaggagcauugucuacaaauuagaccucuuaaaaaccagcccuuuuucaaaccaggaucgggaucuaaaaccaucaucggcacagcgggcacccgccuaaaaaggcucugcacuccgcugugcuuggaaaagugagcuuucucggaauugagcuuguuuacuuaaauuuaaaaggacccuuaaugugcauucugagccucuguggagaaaaaucacuguagcauuuucugagaggauuuauccaaagcaccccugugaguuacagcuaguagccccgucccuaaguaagagaccgcgaacacacuccagugugucaacacacggcucagucaaguaucccccaaccccaccccauacacacacacuuuaaaugauagaaauguuuuuaaaaauauuaaaacuucuggguucucugggaaaguauguaaaagaaaacacagaguucuaaaucugguuagggggagaucaaccauacugacuucaggcaaagggaauuuauaagaccucugcuugagacaagggacauaaaaacuaccaucuagcagcaacagcaacccacugagaagaccguccuuagggcagcuucucccuugcaauguuuggaaaacccauagccucagucaggguuaugcagacgcucagguaacacaacaguaaaaaggugugugaaucuaaaacugcaucccugaugcuucuagcaucuuccucugcauggacguuguuaggauacaggcgauccuaccagccugcucucagggucguagcagucaucaccugcugcuuccaaggggugugcugaggauaaaaagccccccccauuccccucucugccuccucucucgggcuucuccugugcccucucucuuugccuucaccucugccucccuccccccaccacugcccucugccugcugucuguggauuauuaguauggaagcucucagccacugcuccaguggcaugcuugccugccugccugccugccugccugcugucaugcuccccacuauauuggucaugggcucacccucugaaacuguaaucaaucccccaauuaaaugcuuucuauugcaugucgccaugaccauggugucucuucacagcagaacaggaaguaagacauagcuagagcuuugaccucuacugugaggucaagggugaguucagagcugcagagcauacauacaagcuauccaggacaaaucacgggccaucauccgucguccuaaacacaaaggcagcaaaguaguacucuaaagugacagaaaaaugaaaauggcagcugugagcuaaugcaggaguaugcaccuguaauccuagcacccaggacagcgaggcagguggauugcugagaucaaagcaaacaaaauauacagugaauucauggcuaguauggauauacaugaugagacucuaccaauaauauaaaaucggguggcagagugguuuagcucacaccaagccugauaacugauaaguucgguuuucaagaucaacaaugugggaggagaaaaccaaugccaaaaaguuguccucugauuucaacaauguauguuguggcaucugugcucgacuccaaacacacgcaaaguagguaaaauauaagcaucaaauagucucaagacacaaauuaggaugcagaaacauuucacacaauucugguaaccugcauccuggguuucuuuuaaacccuguacccaggaguuccuaacaggauguauuuggagcagacgucaguauaaggaccuaaauccucacuuaacugcuacgugcaccacauagccaaggacuucagccauggcuuuucccaaaggaaucugccauuucagaguaaaauaauuacauuauguugcugccuaguaaauuugauuauaaaauuuguuuugagccgggcgugguggcucucgccuuuaaucccagcacucgguagucugaggcagguagauuucugaguucgaagccagccuggucuacagagugaguuccaggacagccagggcuauacagagaaacccugucuugaaaaaaaaaacaaaaaaacaaaaugaacaaaaaaauuguuuugaaauucacugugugccguggaaaaccuacagccaugggaugacauaaaauuucaaccaggagaaaaaaacaaaacaaaacccacacacacccaaaagccaguggcauccccagugaaguguuuugguuuuuuuuuuaagauuuauuuauuuauuuuaugugugugagcacgcuguccuugacacaccagaagaaggcaucagaucuaacuacagaugguugugagccaccaugugguugcuagaaauugaacucaugaccuucugaagaacagucagugcucuuaacuguugagccaucucuccagaaccugaaguuuaaauuuuaaauuuugaaaaaaaaacaaaaaguuuuggagacagggucucauuacguaacccaggcuggcuucgaacucacaaagaucuaccuaccucugucucucaaaugccgggauugaaguugugcaccaucaagucaauggugaucccugccuuuaaucccagcaccagggaggcagaggcagaggcagagggauuucuauaaauucaaggucagccuggucuacagagugaguuucaggacagccagggcuacacagagaaacccugucucgaaaaccaaagcaaaccaaauaaacaaaaacagaugugcccccaccaugaccaaccaaaguaugagaaacugucaaugccaaugcaguuucucaucaaaggcauguccccaaaucaaggguggugccauauacuugucauccagcacugagaggacuguucaaggcaaucauuuauggccguaauucucaaccuuucuagugcugcaacccucuaauacaguuccucaugugauguugacuccccaaccauaaaauuacuuucaacuguaauuuuccuacuguuaugaaucauaaucuaaauaccugguauuuccaaugguccuaggcuaccccugugcaaagguuguucaacacccaccagggguggagacccauggauugagaacugaugagguauuacacaagauccugucuaaaagagguaagacaucccuaacauagguaccaguaacuucaccaugugaacgugaucaagcuacauuguauguauggauggaauuuucaaagaauuacuaaaaauguuuauaguucuuaaaagauaaaaacgugcucauggagagauggagaguguggaauucacagaguuccaacuuuacaggaucccccuuaacaucagggcagaaggcagagcuggccaggaggaacacacugaggucuccauacuaaaguuuucccuacucugcaaaaggcagcaggcaccagcauuucuuggcgguucuucgucaugccggugguugggauauacagaaaggggagcagacguuuacuacuaauuuagcucaauacuggcaacacguaaaaaacauaaaaaccauccacccuaagaaaauucaguggcuuugagacaucuucauagagggauugcugucuuuucuuuuuaacccacucagaauguauugaccaucccuuugcgcuuuucaauucucuucugugugccacguuucuguugagaaggaaauaacaagugaaaccgcuugucuuguuuuuugcagacugcaucuaaugcaaaagcauuccagcaguccaggagaaugugauuuucccaggagccgacaagugcuaugccaucauccgaugcacagaaccguucuagcacgaagaaaacagcaaauugcuaauucaccaagagccaugcaaggauugccaaaagcauccaugcuggguucuacaccacuucucaccugauuuaagcaucucugacuuuuauuccuuccaaagucugcuaaggaggaggcccacggccaggcggcucccugaagguaaguuagaaggcacagggaagaaugcuguggagcaagguggccagguggcccaaggacuucaaaaaaagguuccuuuugugggaaaagaagaaacaaagugucccacacaccaucacacagauucuuuaaugaagucauuauauauuuaggucugauaauggaccagagggaugccaucauggugaauauacuucaaugguuauuagcaaaauuaaaaugauaaauuggaauuggauccgcugacauauauucuuagguuuguacuucauagaauccaggccacugcaaaucaaaauaaaaguggucagcacccuaucuugcagccuucggcaccaucaagauuuacuagacuggccagugggagagaaggcuuuuauacaucaacccacuggcucuaaagauguugacagugguuccuucuauaaaucaucuaacacuguucucuguuaacacugcucccagauuuucuuggucaggaaaaucagaaugcagguguccccaaguuuauaggaggggccuaaaguaucugagaagagaagcagggggcuuaccugcuggaucgugggggcagagaugggggaggguuggaggcagguuacaaaacagacccacacaaaucuaggaaguuggagaucagcacugcacagaacaggaggccaaaauaacauuugacuuggugguuuuguuaaucuuuuaaguuuuguguguguguguguguguguguguguguguguguguguguguaugugugugugugagagagagagacagacagacagacagacagacagacagacagagacagagaaggagucagagagagacagacagagacagagagagauggagaggggaugggccaugaacacggaaagucaacaucaggagucuguucacuccuucuacugggagccacuaagccauccugccagccauuguuugguuuugcuauacaaaccagggugcugagauuguaggccugcuacaccaugccuugcugaagggcaccaguaaagaagcauauagggucuggagagaucacucaguaguuaaaagugcuugcugcucuuucagaggaccugaguuuggcucucagcauucacccugcggugcucacaaccaccuguaacuccagcucccgggcauccuauacccuuucuccuggcuuccauagguaccagggcaccuguaucuuacaaacaugcaaauauacauacauauacagaguuuuuaaaaguguugcucucuuuacuuuaaaaaauauauauauucucaggacgggcaggggugguccacaucuuuaauccuagcacucaggaggcagaggcagguggauaucugaguuggaggccagccuggucuggauuccaggacaacuagagauacacagaggaacccugucuugacacaaaacacacacacacacacacacacacacacacacacacacacacacacacauacacaccacacacacauacacacacacacacacaucccccccuucagaagauggucguacuguagaugggagucguggagccuuugcuuuuucuagacaaauacgggauuacagaaaguaacuugcucugaaucuacagcauauaauagaaacugggaaacuuuugguuuuccucaucacacagcucauacaacuccucuuucuccagacagcucauccaaaugacagacuagcauacuugggaaauauucuuguuuuuacauaaucccucacucuuucauuguuggaaaaucuuugacuucauggucucaccauauauaccaggcuggucuugaacucagaaagauccugaguaccacacuuggugagagcaauuuuccgagacaucugaagaagcaggugcaauaaaacaaauacaagaugcauuuuucucaucuugaacuugccugucacucuccuaagacaaacuccucuuucccuugagaauucuagguuugauaacuaggguuuugugaaagauacaugagaucaaacacaguguacccccaggcaaggccaaaaugacaaaccguuugaugggaaucacugucgagacaguaccugucugaguuucacuuuuguugccaugauaaaagacccuggcaaaaagcagccuaggggggaaggguuuauuucaguuaaagccaggucuuaguccaccacagaaacuacaaagaguaaaucacaccacauguaguuaugagcaagaucgaggcaugcuaaucccagcacuugggaggcagaggcagguggaucucugugaguuccaaugacacgagggcuacauaguauugcaugcucucaauuuugcucuuuuauagcucaggaacucuacuuagggaauguuucgacucccagugaguugggucuucccacaucaguuaagauuccaacagacuugcccacagcacaacccaccauagacagucuuugagacacucuuugagaaacuugcaaggggacccuggguuguguggacaacuaaagcuacccgucacaguauccgucuguaucauaaugagagaaguuuugauguuagaaagcaggcaagcuugcauggacaggcaaaguuuuaggauggaucaugaauuugauaacaucccccacucuguugauuccuggaccaugaucucuuucgcaccauucucgauaugguacagauaagacuugaguacauucuagaaacuugguacccgguguagccauguuccauagauggagcuuuggagaaguagacuagaaggagguagucagguuuuaggaguuacaccucaggaagugauucaugugugcuuccuugaaugaccagagcagaccuucccucaugcuugaccccacucugccuuuguuucuccaacacauugcaaaguagucugggggucuuugugaagaagucagcuccauguugcugggguucuccagcaaccagaauuaugaaccccguaaucaccuuuacccuaccccucauagucuuuagaaagaggucggguuuauugugugugcugcaaaggacacugggcagggcagcaacgagagugccacuaggcauuuuguuacaguaacagcaggcagacuaaagucucgggacuaacuuugcaacucaaaccaucauuuuccccaagccuccaacucuucaagucucugguuauuauuagacacaugauuuacugcucugcuggguccccacagccacacaaagcugaccuaaggagccaagcuguucaggcagaagucagcuugggaggugcaaagagaagaagcugaagggagauauuuggggccuacagccugccugaggauauggagauguaggaacuauuacagcuuuccuagguaacauccaacaauccacacacucuaaaagucuacagaccagccuggccaaagugagauggaugaagagaacugcaggaagcccagagggccggaaggacauucaugaguaaggaggcaugagggaagugccugggcuagcagaguggagcugagagacuuccuguucuccacugucaaacacuaagcccagaggggaaggggcacugggcaggcuggguucaaaucuagaccucacaaccuugcacaagccacgucccuagccaggcuguaccucagccuccuuucuguaaaaugggaauaaauguguccagacaacaaagaguuuauuagaggaaugcauggaguagugagggaaagaaagggaagcaaauccuggagaacaaacaaacaaacaaacaaacaaacaaacaacaaaggugagguagaaggaguguaaaaagcaaacgaaaaucagagacacugagugccuuagggucuccauugcugcgaacagacaccaugaccaaggcaacccucauaaggacagcauuuaacuggggcuggcuuacagguucagagguucagucuauuaucaucaaagcaggagccuggcagcauccaggcagggaugggacaggaggagcuaagaguucuacaucuucaucugaaggcugcugacagaacacuggcuuccaggcagcuagggugagggucuuaaagcccacgcccagugacacacccacuccaacagggccacaccuucuaaugguaccauucccuucgcugagcauauauacaaaccaucacacugggucucaacuucauagauggcccccaaggcaaggcuuacacuccuucaauaucagcuacagcagugguucucaaccuuccuaaagcugugacucuuuaauacauguccucauguuguggugaccccccucaacaguaauuauuuuuuugcuacuucauaacuguaauuuuguaaacaucuguauuucugauggauucuaacccuuucacaggggucugagacccacagguugagaaccccuggucuagacacaauggaccacacacaaauccuggguagagagcaucugcuccuaugugcaggcucagaauuccucccccgcagcaccauggacagcaaaggguaacaguggguugaguuaagauuuggggcuuagcguaggaagcuaauccucacacacagagaaugucuaugggaagauguuuucagauccucaacaaacugggagcaaauuuugggaacaaacaaaacaacaaacaaaccugguagcccagguugugcuggauuaaaugagaaauguccaccauagguucacgcacuuggacauuuuguguccaguggguagugccaucuaguggguagugcugucuggggagguccuggaaggugcccaucacucaauacaucacuuuggaagcuuauagucuugccccacuuccaguuugaucucucacuaagcgcuugugcggaggauaugaucucucggcucccugcuccagccacuggcugcugugccuacccugacuuuacggccucccacucugaaacuguaagcccaaauauucauaaguuaccuuggaucaugggauuuuaccccagcaacagaaaagugaccaauacaaagggccgacuuacaaacaggguaugccuucugagguugcaccuccucaccacccuaaggcauucucugauugguuuaauaaaucugauagucaauuagcugggcaggaaauggauggcaagacuuccugggagggagaaaggaacuccuggaaaacgaaagagaaagaccuuuugccaggagacaugggaagagacgugucuaugggccuggaagguauagcuaaccgugugucuggauggggcuagguaaucaggucaacuuagaugagcuacuuaagagucuaccuaguugccgggcagugguggcgcacgccuuugaucccagcacuugggaggcagaggcaggcggauuucugaguucgaggccagccugguccacaaagugaguucuaggacagccagagcuauacagaaaaacccugucucggaaaaaaaaaacaaaaaacaacaacaacaaaaaagagucugccuagcuggggcuggagagauggcuaaacaguuaagagcacugacugcccuucugaagguccugaguuuaaaucccagcaacuacaugguggcucacaaccauccguaaugagaccugacucccucuucuggugugucugaagauagcuacagugugcuuacauauaauaauaaauaaaucuuuagaaagagucugcccaucuaaggacuaugcuuugaaacaguaaaaagucucugugugauuauuuggcgaacuugcugguuaaggaauaacugcagccauaucaauuuccauuaauuaauauguacagaauguuaguaaucuuuacacauauggccagcaagauagcucaguggauaaggguguuugcagccaagccugagggcucuuguuuaauccucaggacccacaguaggagagaacucacucccacaagcugccuucugaccuccauggguauacaauaauacauagagcuugugugcacacacacaggggcuuccccuaacugccccuauaaauaaaaguaacugaaaauauugguaagacggggauggagagauaaacucaauuuuugugcauauuguauuuucagaggacccaauugcuggccccagcacccaugucaagcagcucucaaucccauauauaguucuagcuccacagcgaucugauauuuuuggcccccaagggcauuugaauuuaugugcacauaccuacacaggcacacacacacacacacacacacacacacacaaaagguguuuuuuuuuucuuuugguuuuucaagacaggguuuugguguauagcccuggcugaccuggaacucucuuuggagaucaggcugggcucaaacucacagauccauuuaucucucugccuucugagcugggaauaaaggugugugccaccacuuuccagcaguuaauaauaauaauuuuuuuuuaguuuaugcucugaccucucucuugcucccuugcucccccuccccauucccuugccccgccuccacacggucauggccggccuccacauaucuacucucuguucucugccuuucucucugccucugcuacucucuuaacuccccuccccaugcccuaaauaaacucuauucuauacuaaaaacaaaagcacgagagguuucuuguuucauuuggacaggguuccguaucccucaugcuggccuugaacuuguuauauaacugaaauaaccuugaacucuggauucuccugacuuuauuucccaaaugcugggauaauaagcgugcaacaacaccaugcacagcuugaaccaccaauuucaaaguagauaaugacauaggcaagagccaaguggccaauaaauauggcucauagccuaaaauuacuggcuggcauauggaauuauauuuauauacguuccauagccuaaggaaaugcugaaaccaagccaaugcuaaggcuucacccuucaccuaucaaggcaaucaaagcacgcgugacacuggaguucaugcuucaggacggaacccaggacggacccugaaaaucuuccaucuagccugcaucgaggcacacacaaguucagccacacacccuaggaaauggcagcauuaaagacucaguccauaccuucauuuccccaguauauagacccuucccacugagcagcgaggcccagcagcuuaggugaaggagcccucaggaggaaggaacagagacaaagccauuuccugcagaauggcaagcugcugucagugugcucgcucgcaaauacaaacgacagccugcuuagcuguaaagugcuuguuacauuacacaaaauauaaggaaugaguguucuacagaugcaagcaaagugagacuuuuccaagcugacuacagccuagagaaaccucaugcucaucaauggacgccagcauggguggggccggguauuaucuaauaaagaaagcauggguguuaaccauauuuauuuuucuggcagcagacugcuaaggacagaaggaugcugagauuagcaugggcccuaugcaggaaggacacagaaauuugcaaaguguuccacauuucuagauagagucuaugcuaaagagauacuggaagcugaagggguugagcguauucagaggccugacuuguuccuuguuuaacaaguaaauuuggaagagauuuacuguaugaaaaacugggacgguguaacucgaauuuuguauacaaaaguuguuuuccuauugcacgggugccuauaugcccauuuuagcauuuguaauagcaaaacaagggcauugcccuaaaugucgaugagcacauauauuaauaaaggauauuuauaucacuaaacaaguagccauuaaagcuuugagcuggauguuuguguauauguacauguauacacacacacacacacacauacacacacacacacacacacgcuugacagaaauaggaaagagaaggggaauaggagaugguggucugacuagcuuuggcccccauacacucauguguucgaaugagguguaaccuuguuggaaaauuucuguccuuguuggaggaagugugucacugugggggugggcuuugggggccuauaugcucaagcuccucccauuguggaagaggcagccucucauggccgccuuccgauaaagauguagaacucuuggcuccuuuucuagcacugcgucugccuggcuacugccaugcuuccugcuaggaugauaaugaacuguaggcagcuccaauuaaauguugucacuuauaagaguuugacuuuggucauggugucacuucuuagcaauggaaacccuaccuaaaacaagacugucugcccaacaggagggucaggguaggacuugggaagccaccaaggcagcauuggugaggcauuugugcaugugcaugucugcagcuaacuacugaaaucuuuaugcaaaugauacagagggguaagguaaguuuuucuguuguuuauuuuugagacagggucucuuguagcccaggcuggcccagaauucauaguguagcugcgggugaccuugaacucccuuaaggaugugaaccaccacacagagucugugagauacaaaggaugaaagucagcacuucacgaaugccagucaagugcuccaucaguucagcuccaagaugaaguacauccuaacaaagaaugcuuuugcuuugauuuuguacccugugcucaggcuaaccuagaacucacuagguagcacaggaugaccuaaaauccaagagguagagguagagagaugccucuaccucugagugcugggaucccaggcaugugccuagccuggaggauguuuuugagcuggucauuccuaucuuagccaccaaucacuuccuccugcuaacaauaguaccauuacuacagagagcauaacccagcucaugguggacauucaaaccccaggcuucccagaagccacgcucugcucauauucugaugugcugacucuuugauaacaguaagcuacucuuggcuucucuuucauugaaaguuuccacauagcuacaauggaugcaaacaaggagcucaaaagcagaaugugaaauaaagccaugaaacuuuaagcuucuuuuaaaauuuuguuuucuggagacagcuucucuggguagcuagcccugguuguccuggaacucacucugcuagccucaaacucagagaucuaccugacucuaccuccccagugcugggauuaaaggugugggacaccaccacccaccuaagacaggaaaaauguaagaacuauuuggugauacaguuuccucucugaauacuuuaauacuuccaggaugcacccacacacaugccugaguggcuaauaugaauaugauuaaucauuuuguuguuguuuaucaucaccuauaauuccagccuucggaggcugagguaagaaggucucagguuccaauuaagacuaggcuauacuauuaaacuuuaucucacuaaacaacaagccaggaggauguuaauuuuaucauaaaggaugaauguagagggcuggagagauggcucagcaguuaagagcacugacugcucuuccaaagguccagaguucaaaucccagcaaccaccugguggcucacaaccaucuguaaugauaucugauguccucuucuggugugucugaagagagcuacagugucuucacuguauauauaaauaaauaaaccuuuaaaaaagacacaaaccaaaaccaaacaacacaaacaaaaaaccacaaaccaaaaaacaaacaaacaacaacaacaacaacaaaaaaaaaaaaaaaaaaaaaaaagaaccccagaaggauguaaagucccauuaaaaauauaucaugccaggacaaaaaaaaaaaaaaaaaaaaaaaaaaaaaagguuaacaguuguggggcuggugagauggcucaguggguuggguaagagcacccgacugcucuuccgaaggucugaaguucaaaucccagcaaccacaugguggcucacaaccaucuguaacaagaucugagcccucuucuggagugucugaagacagcuacaguguacuuacauauaauaaauaaaucuuugaaaaaaaaaaaaaagaggcaguuguguguguguuuuacacacacacacacacacacacagagucaauuuucugacaaaaagcucaucuacuccaggugggcuucaggcuccucaccucccccuuucaucugcuaaguucugggauucuggucagugccaugcagacuuuaugugagaugagaaacacguguauugcuuacuaaacaguccagccugagccucauuuguaaaugacaaccauuucuuucaguuccauccaucaagggcuccaucccccucuguuguuucuggagaccaguaguaauggaccuaucuuaauuugugcgugcguguuugugugugcgugugccugugcgugugcguguguguguguguguguguguguguguguguguguguguguaugugcuuagugcaugagucaagguggcaaggucaaagaacaauuagcaaacacugguccucuccucccacccugugggguuggggaacugaacucaggucagugucaaguuuggugacagauaccuuuucuagcugaguugucucacagggccccaaauaccuuuuuaaagugaugcugcagucacugagagaugcauccaaaacuaggggagcugcaccccuccagagcuagaguaaaugccucccuuccacuggguggggcuggcugacucugcaggggguuuaaugagccgcgcuuuccuguuccacuaaagcccuaagcacaacuguaagcgggcacucagauauuagcaacaaugacuuaauuccuuacaaguaugaggggaauucuuagagagagaauugcaaaaucuuaacuuauuccuggauccaacaagucauagcaacaaugauacuucacagcagcacugugagcgacagaauccccucggaggcugugaaggagacgccacagguacugugcuagcugugcacauaaagaccuggaguggguuugacuuaguucuguuuguauuuuaauguuaauuugccccccccccaaacuguuugcaggagagaguccacccuugaaacacugagggaccagcccccagcuaauucugaaugguaaauaaagaugccagcagcucauagcugggagaagagacauaggcgggguuuagguuuccuggacggaggaaagaagcagaagggggagacacucuuagaagaguaugcagguguaaccucccccagccugaagcaggcuaagccagaccuugaccuugaugccacaaagauuaccuagggaggagccuuccucccuagaucacucuauuguucagccacugccucuguuccccuucaagacacuccuaccugcugggaggccacuauuccggagacuacacccuaucaugcacauaguuaccugcagcugguuccaggccccaagaaugaauuggugggaaugggccucccccacuuuauaagggcauuugccauuaaacauuugagcuuugaucaggaaucuugacuuagcuccauuuuucucucgaccgccuaguuccccucccuuuucagccccugcuugccucccagguguuucuugugagccacaggaaggcuuccaacaggcaggagagagauggaagucaccauggaguagagaagcaaggagagcucccugggcucugggccaagagaacguggcccagagggcugacuaauuggaauuaagagcagccaggaugaaaccuagaaauuaguaaguagucacuuggaguuauugaugggaaaguggucucuuaacagcauggaggggaggcaguugcccagcuauugagcuacuuaaggcauauuaaaauauaaaggcugugugugucuuucauucggugggucguaaccccacgccaggauuuauucauuuuuaacuacaaagacuggagcaccaccgaaaagcugaguggugaguaccuguaacuccaacccugggagggauggaggcuggaagaucccagcugauugcuagccagucaguguaagcugaccugugagcuccagauucgggaagagacucucaaaacuaaaauggagcggucaacaacauggcucaggagguaggggggcuugcggucaagacugacaaccuaaagaccgacccaaaauccacauggcagagagaaguagcucccacagguuuucuucugcccuccacauaaacaccgugaaacacauacaauaaaaagauaaagguaaaaagcauuugaaaaaaaucaaaacccaaucaaggacaagagagaucaaggacacccaauaucaacaaacacacacaugcauggauaaccacgcccacgcaagcaccacccucugucacacacaaaaccaauuccuauaguuuuuuguauuacaucuaacuuucauucaauaaguuuugguuuuguuugccuuuuuuccagucuaagacaggguuucucucuauagcucuguaucaccaguuuugguuuucaaaguucaguuuuucagcaggucuauucccguguuuuccuuuuccaugugcaugguguguauauguguauguuugcauacaggcacaugcauguagaggauaaagguugauguuuaaaaugaugcccugaggcuagacagauggcucagcgguuaagagcacugacuacuuuuccagagaucaugaguucaaaucccagcaaccacaugguggcucacaaccauccaucaugagaccugacucccucuucuggugugucugaagacaacuacaguguacuuacauauaauaaauaaguaaaacuuuaaaagaaaaaagaaaaagaaaagagagagagagagaaagaaagaaagaaagagagacagagaaaggaaggaaggaaggaaggaaggaaggaagggagagaaaagagagagagaaagaaagaaagaaaagauucccuggaacucaggcuggccucaaacucagaucuuaaugcuucugccuccuaaaugcugggauuaaaagcuuuuguuucgguuuguuuuuuuuuuuuuuuuuuuuccgagacaggguuucucuuuauagcccuggcuguccuggaacucacucuguagaccaggcuggccucgaacucagaaauucgccugccucugccucccgagugcugggauuaaaggcgugcgccaccacgcccggcuucgguuuguuuuuuguuaucuauuuuuacuuguaugugcgugagugcgcuguacuguagcuaugugcaggcuucuagagaaggcaaaagagacaucagagcucaggaagcuggaauuacaggcaguuauguaugagccauggacauauggguguugagaauguaagccagguccucugaaagagcagccaguacucuuaaucacugaaccaucuuuccagccccaucacucaaaaaaaaaaaagauuuguuaaaaaaaauaacauuuaagccaggcgugguggcgcacgccuuuaaucccagcacucgggaggcagaggcaggcggauuucugaguucguggccagccuggucuacaaagugaguuccaggacagccagggcuacacagagaaacccugucucaaaaaaccaaaaaaaaaaaaaaaaacaaaaaaacaaaaaacauuuauuguuguacauugaaaauuauauuucaaguucucuaugcugaacauuaccaaaaucaugcuuacauauaaaauuucacucuggccaauuuguuaaucaagaacuauugggaucaggcaaauacuuaguggugucaccaaguaauuuuuacucacacuaauguuuacuuaaagcagcagacucccuucacacacaaaugcuaaacaauuaaaagcagucaaaaugagcagaaaauaacaaauaauucuucaggaaaacaaggaauucuauugauuucaucuauauaaagacauuuaaaaaaauuaaaaccacccucucugcaccccucaguggagaggaauauacacaaccugcacuuauccaucuucagcaagaaaugauguggugcagguggucccaggccaaagcagaugaaaagaaaauaacccuguaagucuuucuuucugccuugccagcaugccauaaauaagauuucucagauuugccaggcaugguggcgcacgccuuuaaucccagcacuugggaggcagaggcaggcggauuucugaguucaaggccagccugguguacagagugaguuccaggacagccagggcuacacagagaaacccugucucgaaaaacuaaaacaaacaaacaaaaagauuucucagauuuaauguucccaagucaauauaauauguaaaaaauauucugauuuaaaaaaaaaacuuauaauuuuaacuucugugugugugggggcaggguguacaugcaaaguucugaggacgacuuguagaaguggaauugcuucucucuuuccacuggguaguaggucucagggagaggaggaagguugguuguaagguuugcugaacccucuggccaacgcccaaguguuucagcagguuagugauuuucuuuuccuuguguauauguuugcauauucacacaugcacauacaugucgaagcuagagguugauguuagauaguuuccucaggugcucuccauuacuuaaugaggccgcaccucuucaaagaaccuggauacaaguuauaaaagaguucuugaugguggugguacaugccuuuaauucuagcacuugggaggcaaagacagaucuuugaguccagccuggucuacagggcauguuccaggacggcuaaggcuauauacagagaaacccugucucaagaaaccaaaaaguucggguuguuauaauucccaagguaugguuauuuuucuucucuaguaaucaaacuauaacgcuuuaggugaucagacucaaggcaaaaacaaaucagggccuucugaagcuccgacuuuauaucugaggcugaaauaaagcagcuggucaacucccagcaaagggaucgaaagccuuggagguuuuccuucuucaugaccauaaaaagcaacaagcgggugacauuucccugcacucgaguuugccagcagaggaauuugcaaccccauucaagcaggcugucugacccuucccugcucuuccuucaaguucacacacaggcacaaaucuaguauucacucugcaggaucgggcaagggcuugaggaacauaguaauuuauagcuuuuaaacuccacaguaguccaauugucuccagcccuagaaaacggggugagggagagugcgaaggcuuaaugcggggcuugaaauuaaaccuguaaacaguuauuauugcagucagaaagucgaaugaaaucugaagcagguuaucuggauucuuugaacaauaaggucaacucugagaguucuggaaacuaaauuuucuaaaccaucccuauuguugccccauuuucugcuucaucuccuaugcgccucgcccuguugacuaucgccacaucuggcugcaauuaaauaagaagauaagauuuuuuaaaaagggauagguagguaggguggcucugggcuccaaaccucagcacuugggaggcugaagcaggaggaucaagagcuccuaccuagcagggauagccugucucaaaagaggcacaggacauagguuugauuccccagugccauaaaaaauaaacuuaaaagccuggcgugguggcgcacgccuuuguucccaucacucaagaggcagaggcaggcggauuucugaguucgaggccagccuggucuacaaagugaguuccaggacagccagagcuacacagagaaacccagucucgaaaaaccaacaaaacaaaacaaaacaaaacuuaauccauuacuuaaaucaaauccugguggaggggcgagguggcugcgguuaaagggcuugaaggucugaauucagucccaagaggccaugggaagucaaaaggaaagaacagacuuuguuaggucucaaagaaaccugggaggaacggcaaggucccuauuaacauaucagaacagaucucagccaguucccccaaacccagagcuuguggcuccucccacuucucccagcaucacucagugccuguggcuccucccacuucucccaguaacacuuugaacuuguagcuccuuacccuaaacuucuggggggggggggggcugggcuuccucuuccuuuucucccaucuucuguacacuagggcaccucccacuuaaauagggucucacugugcagcucugacuuuguagaccugcuuuguugaccagguuggccuugaagaucuucccaccucuuccuccccaaguguugggauuaaagguuuacacaaugccuggcgauaaacaagaauuuaaacguaguaauauauauggggauaaagucucacagugcagcccaugcuagccuuucuuucuuuucuuuuuauaagauuuauuuauuguugugaguacacuguagcugucuucagacacaccagaagagggaaucaggucucauuaaggaugguugugaguuaccacgugguugcugggauuugaacucaggaccuuuggaagaacagucagcacccuuaaccacugagccauugcucaagggccagccucuaacuuucaaucccccugccucagagacuuugguguucaaauuacaggugugugccaccccaugaguccugcagaaaacuuacuuuuacacaacaugaaaccagcccucccuuccucuacucaaagagauuuucuuuuuuguuuuuuguuuuuuuguuuuucgagacaggguuucucuguguaguccuggcuguccuggaacucacuuuguagaccagucuggccucgaacucagaaaucugcuugccucugccucccaagugcugggguuaaaggcgugugccaccacaccuggcgagauuuucuuuuaacguuuaaaaauuauuucaguucuagcugugagugagcauggugggagagccuggagggcugaagcaagacugaaugaauuugagucagugugagcuacccucagagaccuugucucccaaauuaaacacacauuacuacauuugugugugggcaugcauaugccacagaauucccuuaggggccaggggacaaauccuagguguuacuucuuuccucccaccaugugggaccuuaaaaaucaugucaccagguugagccuuuuucuccuuugaaaaccuugagguuuuucaguagaguauaugugugugugugugugugugugugugugugugugugugugugcgcgcgcgcgcgcgcgcacaugggggggggggucaaccguccuggguuuuaucccauuacagggcaggccucucucacuggcuguauucgccguuuuagccuuuaugguggagcacuaauuuacaauucugggcaaaguacaguuucccuaagcacaaguucuccauagaccgcaggugccguggucaucuguaauucuacccggucaaguucagucccccuaaagugccuaacaucaccagagaggauccccaguucgcuuuauguguauguuugcacacaggauuuccuguaccccaggauagccucuuauucuguagaguaagcuggcccaagugcugagauaacaggaguuugcuacagaugaaacccagggccauguguaaugcccaaguguuguaucaacugaacuguauucccagcagcccagauccccaguucuucuuaaaggacucuccuuccuuuucuugcuaaggguacuuaacuccuguuuucucccccuacuccucuucucuugccuaugacuauuacuaguuuauuuuaauauguguauuucucgucuaugagaguauaugucaccuguguguggguucccaaagaggccagaagggaccaucagaucuucuggagcuggaguuauacgcaguucugagccuccgauguggguucugggaaccaaacucaggaccucugaaagagugggaagcuccuacuuaucaaucuuuaaaauaaaaucuauuucagguucacacagccacaaauauauauaucucaaucccacauaugacuuuccuuuucuuggagacacaggcuuuaacagugaaucugaacuuugaauccagcucuccagagauggagauggcaacuucauccugccugccgccuaauuugcuuaagauggcagcauuagagcuggagagauggcucagugguuaagagcaccgacugcucuuuccaagguccugaguucaaaucccagcaaccauaugguggcuuacaaccauccguaaugagaucugacguccucaucuagugcaucugaagacagcuacaguguacuuagauguaauaauaaauaaaucuuaaaaaaaaaaaaaaaaaaaaaaaaaaaaaaaaaaaagauggcagcauucugggagagggaucugcuggguuccagggcucagagagacugccugagaagcuuucucuggccaguguaauacuuuaaaccguggccuacuucccugauuccucgcauuccucgcauucuuucaugucauaagggacuugacuugaaaucucacuguuuucaagaaucuagauagcacuguugggucucagucugucaccacaaaaaucuccacauagaauagcaauuuaaaaaaaucuuaucuaaagacuccagcuucuacuaaaagaaguacugguuuucauguugaucaaagcaaacaaguuuaguuuauuauaaacaaaacaaaaggcuuacuuaagacuuacuugaauuucuuucaaggaaauuuuagcccuugaggcuuugcaaucaagaguauguguguauaaaacucaaccaaccuggguuuuguuuccauuacagcccaguauucucugccucacuuuuauuuaccauuuugugccaagacugggagaaacugugauaauaaggaaggauuugacaacauuuauaacauucccuaccgugugagugacuuauuuuauacaaaacagagcagagagauuucgaauuuccauuuaaauguccacaguuacaauacagaaguuggagcucaacucuaaauacugauuugcuuguauaugucauuucugaagcaauuaaaaaauucucagcucucgggaggcaaaggcaggcggauuucugaguucgaggccaaccuggucuacaaagugagcuacaggacagccagggguauacagagaaacccugucucgaaaaaccaaaaaaaaaaaaauucucauaacccagguggugguacacacuuuuagucccagcacccaggaggcaaagucaggaagaucucugaauuugaggccauacuggucuacaaagagaguuccagaaagccagggcugcacugagaaacccuguuucaaaaaaacaaaauaaccaaaccaaccaaccaaacaagcaaacaaacaucgaucauggagaguggauguguaaugguacccaccuguauccucaucauuugggagacugaagcaggaaaacugccuugaauucagggccugccugggauauacagugagacuucgauucaaaaauugaaacaaacaaaaguggccaguuguuagugaucuagagaccaucuuguuccaccucaccugucauuugcacuguagugucaaaccaaguauaaauucaggguagagauggcacagcauggaacugucuacagaauuuagugcucacccccccagugaagaauaauuccaaacaaaagcuucuaaaaaggcauucuccaaaaugucugcuaggacuuagcuuaaaugauugcuaagaaccaaauguauaaaaucuaacaaucauuaaagcaaaggauaagggcgcaaaccugugaacccuggggucaggaagcaucuaucuaaauacauuaauucagccaggaaugguggcccaugccucuaaucccagcacuugggagacagaggcaggaagauuucucugugaguucaaagucagccuggucuacagagugaguucuaggaaagccagaaugauauaguaagaccuugucuugagagagagagagagagagagagagagagagaggaaggaaggaaggaaggaagggagggagggagggagggagggagggagggagggagggaggaaggaaggaaggaaggaaggaaggaaggaaggaaggaaggaaggaaagaaggaaagaaggaaagaaggaaggaaagagaaagagaaagagaaagagagaaaaaaaugaauauauuuuaaaaaguuaagaacugggcuggugagauggcucagugguuaagagcaccgccuacucuuccuaagguccugaguucaagucccagcaaccacaugguggcucacaaccaucuauaaugagaccugacucucucuucuggagugucugaagacagcuacaguguacuuacauauaauaaauaaauaaauauuuuuuuaaaaaguuaagaacuacaaaucaaacaccaccacugcacacugcauaacaacauacccuucaugaaggaaaacuaccaagucacaaugaagcaccuguaugugugugugcauguaugugugugaacuggugguacaggugcaagugugugaauggaagcuaggucuucuccaauugcucaucuuucacaaauuguauuacguguauuucuuguguguacgagaucacgugcacucauccacccauggcauggggcacguguccaggucagaggacaacuucaaggagcaagugaucuccugcuacccugcaagcuucagggaucaaacucaggccgggugcaagugccuuaauacaucaagcaaucuugcugcccugaacuuauaucuauuguuguuguuauuuguuuguuaugacagggucuuacuaaguagcccuggcuggccgggaacuggcuauguagacuaggcuagcgucaaacucagagaucucagcuucugcugagauuaagggcaugugccaccauguucagccccaauuuaaguuuuuaagcuauagucuuucauaaaaccugcaacuuaacaauuuggcuggaccggcuagcuagcaagcccuaaggaucgauccuguucauucaaccccagggauagaugggauuguggguacaugccaggcuuucucacuuggaugcuggggacauggcucgggccaucaugcuuguaugagaaacacacugcugacuaagccaucucccuggcccuccuuuuuuccucaucccucuccuuaggagauagguuuacuauguagcccaggcuagccuuggaguugcucuccugcugggauuuauaggugugugccauccugugugggucaaaguacacuuuaagagaggaucgccaauaucaaggagaauuuagccaguaugacggcacauaccuccaaucauaauacuuacgaggccgaaucaggaagauuaucacaugcuaaaggcagccugggcuacauaguaaguuccaggacagcuuucgcuacagaaugaaacugugcuuaaaauuaaaaaacaagagaaguaaaaagugaccugagcugcaagauggcuuuaacgaaaagcaagccuggguuaggucucugcaaccuaaauuaaaaaagacuuuaauuacauccgggaccccaacaggcccugugagauggaaggcagaaacaggagagaagugcuuggaagcuccagugccagccggccuggagggcagcacaacagagacaagacagacucucuaacacacacacacaaaauaauaauagcauuaguaggaauaauaauaauaauugggacuuucuuuguuuuguuuuguuucuguuuuuuaagauagggucucgccggacaugguggcgcacgccuuuaaugccagcacucgggaggcagaggcaggugaauuucugaguucaaggccaggcuggucuacagagugaguuccaagacagccagggcuacacagagaaacccugucucgaaaaaccaaccaaaaaaaaaaaaaaaaaaaaaaagacagggucucucuguguagcccugacugucucugaaauucacucugcagaccaggcuggccucacacucagagacccgccgccucugggauuaaaggcgugugccaccaccccuggcucaucagaacauuuggaaaagaagcuugcaccggauccacugauaagcaagcacacgcucagacacuaacaaggagagcaaccaccaaaggccuuguccucagcacaagcccaaaagcaggcacgggacaugcacauuacacuacagacacuuuuggaauuuggguuucuuuaaaaacacagaaauauuauaagaauaauaucuuuuguuuuaaucccaggugugggauacaggcugcuucagguggucugcagcagcugauuaugaguugccguaugcucuagcagaguuuuuuuuuucugugauugugugacguuuggaauucugagaacuuuucagaggguauauaaaugcuaaagcccugauaggcgguguugcuucaaggggguugguuguaguuuguuagcagucaugcucagagaagaaacaagacaaaagaaauuagauuuaaggauugcccccuucuuucuuuccuaucuagugauggaaaaagaagaacucacaaaguaucaaagaccaguacaagcaaagaagaaacaagaaagaaauuagacucacggaccccuaucucuuucucccucugucauuucucgccuaucuagugaugggguggggggauaaaagguggaaaaaagaacccacaaaauagcaaagacuggcaacaauauucccccaaagcgagucaucccuaagacaucucuucggccugcaaacagaagggguguggucaacccucagggaccuugucucggauggagaagucuggcuggcuggaguaagugcuguucuggcagcugcccagcucacugccuuuccauuuuaucuucuacuuccgagcucugccccucccuucagguuccacagcauuacccacuucuauugaugaccuccgugacacaccacacccagucuuuauucucagggaaacagcacuauaggagauauauagcuaaguauaagaugccugggccauuacugaagcccccacuuacauauuuauauaccugugacaggcgcuggccauauagcugaccucaaacucaaaucuuugagggugcacccuccuguaaaccaaauuuuauuacuuacaagugauguccuagcuucauuucuguugcugugauaaaauaccccgacagaaaggagcugagcggagaagggauuauuugaucuccguuccagguuacaguccaucacuaguuaaggcagugggagcuugaaguagccacauccacagccaagaauaaagagauaucacugcgugcauaauuacagcucagcuaguucuuuucuuagaguuuggggcuucaauccagggaaugggaccacuccccuucaggcugggucucuccccaucaaucaagacaaucucccagauaugcccauaagccaaccugcccuagagaauccuucacggacacucuuuccagcugauuuuagguuguaucaacuuaacaguuacaagugucucccuucaguggggcagugguagugcuugcuuuuaaucccagcacucgggaggcaaaagcaggcaggucucuugugaguucaagacgagucuggacuacagaaggaguucuguguagccaaagcugccuagaaaaacaaauaagggcuggagagauggcucagugguuaagaacacugacuguucuuccagagguucugaguucaagucccagcaaccacaugguggcucacaaccaucuguaauggggucugauguacucuucucguaugugucugaagauagcuacaguguacucauauaaauaagaauaaauaaaucuuagaaaaaaaauaagcaaaaaagucucccaucuaagugacucucccuuuaggugaagccacuccuucgacuugagcucaaaugccugggaggcagagccagaaccaucacuugaacccggauagccuggaaaacacuggcaguguuguguuuugguuuucggucuuuuguuguuguuuuugguuuugguuuuuuggggguugguuucucuguauagccccggcuguccuggaacucaggcuguugggagaggguuugacuuaacuugguuuguaacccaaucugacuagcacaucauuauucuccucugucgaucuucuccagggcugggauuacaggcaugugcuguaacuguaauuuuuaaauuuggagaguugguugcuuucucuuguuguccuagcuuucaggucuuuauuauuuuauuuauuuauuuauuuauuuauuuauuuugguuuuucgagacagggcuucucuguauagcccuggcuguccuggagcucacuuuguagaucaggcuagccucgaacucagaaaucugccugccucugccucccgaguggcugggacuaaaggcgugcgccaccacgcccagcuucaggucuuuauuauuaauggggaaggggauaugugcuguuucuguguuaagucugggcacacaguuaccaccgcauguguacagaagucagaggaugaguuuuagagucucuucucuccuucuguuguggguucugggucaaacuuaagucaucuagcuugggguggcaucaagcaagugcaguuaccugcugagccuuccugcuuguccccucgcugguccugucugccccgugccaagccuguauccugcucaaauuucacugaccuggcagagaucugagccaaaaguguccuuugaaaaugcucgcuggcagucucccuuugcagccucccuacccaccugucuccagcccacacugucccccagauggacagaucuaggguguccaucgagacggccuucucgggauggaaggcagacauguucuccgucugugcuuugcugcgucagaagcuuucggcgcgucucuaaagccucuccaccucccggguggcucuuacgcccugggugaacugagacuuuagcaucccuuuuccauuauccccuuaaacacauccaucucccuaacaagucucaucucuucccgucuccccaccaacggccuuggacgugacuagaauccuuuuccaaaaauauucuuugcuuuucaaaguaguuaucuagaaaaucgucuuuguggaucuggaccaacugacggcaggucuccgacccucucucucacuucccugagucugucauugaacacugcgccuggccugaggagggcuuccaagguugaugagcgaugcugugcacuuuccugucacacccucaccggugaacacuccaugcuuaagaauuaccuguuugauguacgugauacuggguauccaacccagggccuggugcacagcuagacaagcacuguugcugggcucuaauccaagcuuagcuuagaaaauacgcaugcacuuugcuguuagaaaccagggccucuccguguuagcccaagcuggcuucagccucuggaagcacugagccuacagugcuguacagccaugcccgcaucauacuuggcucucuugaauauauuaugguaucauuugcuaggacaacaagugacaaaucuccacuuccuuucuuuuuuuuuuuuuuuuuuuuuuuaaagauuuauuuauuuauuauauguaaguacacuguagcugucuucagacaccagaagagggagucagaucucauuacagaugguugugagccaccaugugguugcugggaucuugaacucuggaccuucggaagagcagucgggugcucuuacccacugagccaucucaccagcccuccacuuccuuucuacacucagauaaccacagccucaacacucaccucagccuugagaaacaaggaaaauacgugcaauaggaaagaggaaaauacuuuacaccguaacguuuggcgcuauaguugaccagauguuuuuaauuuauugcacaaauacagaggaaagucgucuaauuuuuuuaaaaauugaaacagacauacccauauguagaaaaagguacaagagagacuacgugacccauggcacaaggguaguaggaaauauacauggacaauaaaaucagauuucuccuuuuaggcaugaaaauaaaccuuguggauuaggaucuaaaugggauuggaguugggggaugggaggaacaccuuuaaucucagcacucuaaagaagcagaggcagaggcugguggaucucugaaccuggucuacagagcaaguuccagggcagccagggcuacaaagagaacuccuauggguggugggagggugauuuaaaugggauugggcagagcccugcacucaccugugugaagcaugaggcacuggguucaaucugcagcauauaccuauauuccuagcaaagcugugucucgaaauaaagcaaaacagccagacagugguggcgcaaaccuuuaaucccagcacuugggaggcagaagcaggcggguuugaguucgaguccagccuguucuacaaagugaguuccaggacagccagaucuacacagagaaacccugccucaaaaaaccaaacaaucaaucaauaaaauaaacaacaacaacaaauugccccugggacuuugugugugguagacccgcuucuucuaccccagaaccuucuccaccaagguguaugauguguauacacaacaccugaccuggccugugugcaccagccucccccagcgcaguccaggcacagcagcuucaacucccacuacauaggagaauaguuccuuuauuuucuucuccagaccagugagagggaauaaaugccuuuaucaucuuacaucuucccuuccacccacgcgagcuccaaccuuagugauucuuaaguugucaccuaagccuuaaacaccagggggaggaggggcuugugugccaguuccuuuccucugaggccacagggcacacacugaacaauuagaacacacaauggccuuucaagaauccagacuguggugcuacagugugacucagucucaaacacauaugcacgugaacacacacacacacacacacacacaccucccucauaucaugcuaaugcauaccuaccauuccagcacuugggaaccagaagggucaggauaccaagagcaaacuugcauacaaugauuucaaggacaauauuggucauuaagauaaauccuaucucuaaaaaaaacaaagacaaacaaagcaccaaaguauaaagaagcccaaagcccuaucugcauccuccagcagguucugaucagcagggugacccaaauagaggugcacaagucaaggauggaugugcacaagcccugaggacccguuccucgggguagguguucugcuccccaagcgcugaaaaaauauauuaaaacucacagaagacaaggaaaacagucaguuccguaguguugaaaacaaaacaccuuugagugugcuguguggguggaaauaaaacccaggucuucccaccaguaguuaagaacagcauaucagucgggggugguggcacacgccuuuaaucccagcacuugggaggcagaggcaggcagauuucugaguucgaggccagccuggucuacaaagugaguuccaggacagccagggcuacacagagaaacccugucucgaaaaacaaacaaacaacaaagaauggccuaucauccucagcuaccccaggcccaacacaaaaucuacaacuuccuuuguguugauuguccuaaaauucacaggguugaaagaguuucuacagagcuccuccaccaggcccaaaggaucagaacaaaguggggugacuugcuaaaguuccaggccaccaagcuggaaccaaauuguuuaucugaccuuucagauaucaaaagaugaaaaguuagguaauggccaagcccagcuaugugugacuagagucaucacacaagaaucugagguaagaggacugccuguuuugagccuggguuacauuaagagacccugccuaaaaaacaaacaaacaaaugaauaaaaguuugggcuguauaaaugaguucccuaugcauuaaucuuuacaagaugaguaacuuuugucucugguuuccuuagccaucucuuugcuacaaagucaaccucaagucaucucauccagacaacuauuccauuuuauaaaaggguucuagguagaggccugugagagcagagcacagcccugcaugccuggaaccccaguugcugagagcugagacaggagagugacuccagcccaggcaagagugagaacugugcuucacagacacuggaagacugaugguuuuucgagacaggguuucucuguguagcccuggcuguccuggaacucacucuguugaccaggcuggccucgaacucagaaauccgccugccucugccucccaaguucugggaucaaaggcgugugccuccaugcccagcucugauuaaacuuuuuuuuuuaaagauuuuauuuauuauuauacauaaguauauuguaugucuucagacacgccagaagagggugucagauuuuguuaugggugguugugagccaccaugugguugcugggauuugaacucaggaccuucggaagagcagucgguguucuuacccgcugagcuaucuugccagcccccugauuaaacuuuuaaacuggauaaauguacauuuguauauuucaaaaguggaucugcgcaaagccaaaagaggaaaaguucaaaaccagccugggcuacaguuccagguuagccugggacauagaguacaacaacuuauaguccccaaggcucagccuuuccguuuuauaagaggucccggauucuggagacucagucuuccaacugcuggaaugaagcccugggggcagggugcuggggaccuagcguagccucucaguccuagcagcccaaggggagguguuggguuuugucucugauguagugaaagaacagcaccuucuauaauagggacaaucuauuggcauauagguaaccacgcaggcaaaaccaucacuuuacucaggaguagaggaagguugaaucugauguucaaggacaggauccucaacacauugaguuuggggccagccuggacuacaugagacacacauuuaccaaaaacaaacaaacaaacaacaacaacaacaaaaccaugucauuaauaaagaugacuuucauuacuuuaaauucuagaccauucaggguaaagacagaugacuugggccuuaaaagccuguuuuauuauucuacuucaauuucucagacacaguagcucaggguagucauuuuagaauaauggcacccacaauaucugucucaccacagacacacccuuuaaaacacuggcucaaggagcuggagagauggcugagcgacuaagagcacguguugcucuugcagaggaccuggguucaguucccaacacccaucugguggcucacagccauuuguaauuccagugccaagagaucuaaugcccucuucugaccucuggcaacaccagaugugacaacugugguguauauagauauauauaugggcaaaucacuugcccauauguacauuagaauaaauuauauguuagugacucauaacuccugcagucaaauagaagcacguccugaaagacuugacaagggucuccagcucccuaccuccuggggacacuagccucaccuagcuuucgguagcccuguuguuuucagcuuuggacucacugaggaggagaaaacauagaaagguuaauucagggcugccaagaaggcacagaaugugaggugcuuguggccuaaccagaugacaugaguucaauguucaggccccacaugguaagaggagacaacuccuauacuuguucucugaccuccagguauguauaugcaugugugcacaugcacaugcacacacacacacacacacacacacacacacacacacauacaaauauguaaucauuuauuuaaaaauaaagguugggggacuggagagauggcucagcaguuaagagugcuggcugcuccuccagguucugaguucaauucucagcacccaugugguggcccaucuguaaugagaucugaugcccucuucuggcacgcaggcauacaugcagguagagcacugcacacauaauuaauuaauuaauuaauucagaggcauucugauugcuaaacuuggucagcauguuggcugcagaaaccaagauuuaccagagcaacggaagucuauuagucauuggucacccauggucugucagcaacugaaugaaaauaaaccugcagagaccagagauuauagacacacaauugagaaaaagagaagccaaucuuacuguccccaggagcagucuuaaaccaggaacuagggaaauaacacaggaagccauuuccccuuacaauuugcauaugaagaauaacuauaggacuucuaguuuuacugaaguacaacauagauaaaaccuaggcuggggcauuuaaauguuauaacucuugggcugagucugcaaaaguccggcuugcucuggcaaggcccuggguucaauccuaggcaagaggaggaggaggaggaggaggaagaaacagaagaucagcuuuaguucccagaggcuggagagaugacucagaggcuaagagcacuggcagaggaccagagggaucccagaacccaccgcagggaacccacaucuagcuuccaccggcaugaaugcuggagggugaacacacaauuuuaauuuaaaacaaacaaaaaagcuuaccucuuaugugaccucaugacagaguucaacagaagaguugcuuuggggcacucuuagaaauaacggcuaacuaaagucagcagaacgaggggcucaggacuguagcccagcauccugcccaaaacucuagguucacguucuagcauccaaaaaaauaaguaaauaaaaauuuggacaguauagagaugccaugauguuaauacauauaacauguauuucaggaaaaaaaaauuaaacugaauagaaugguggauccuaacuguaauuucagucuucagaagaucaccaaggguuugaggccacccuagguuuaauagugaguuugaggccagccugggcuaaugaguugauuucuugucuaaaaaaccaaaacagcaaaaaccccaagccaacugauguaccaaauauguagcaucugauauaaauauuugaauauauauauauauauauauacauauauauauauauauauauguaaggauccuagcacucgggaggcacaggcagguggauuucugaguuccagcccagccuggucuacaaagugaguuccaggacagccagggcuauacagagaaacccugucuugaaaaaccaacaaaacaaaacaaaacaaggauaaaagucuuuaaugaucaauucuauaauaagaaggaaaaaaggauaucauucuaucuaaagacggaaaacugucgggcaaugguggcacaugccuuuaaugccagcacuugggaagcagaagcaggcaaauuucugaguucgaggccagucuggucuacaaagugaguuccaggacagccagggcuacacagagaaacccugucucaagaaaaacacaaaaauaaaaaauaaaaaaauaaaaaaagaggggaaaaacuauauacuacauagcaaaccuccucaaaaugucuacagauccaucaagauuauauauucaugauguaauccauaaguaacucugugaauguuucaucugaccccaccccccaauaggggguguguguucauguagccuagauugaaucagcuucaaaaucacagugguccucagacuccugaaugcugggauugcaaaugcaagucuccacacccagccagaccucucucuuucuaaagagcaaacaggucuucaaaucugauuuuccuccuaaaucauuugcucaaucuacuaaguacuagagagacugucauuaucugauacacaaaacgaauccucaugagguuaaaagugaagccggagaaggggacagcuggcauucaccaaugagaucccaagggccaggaccaccacuucuuccaucagcucuugccaaguuccugauguuucgcgccaugcaccuugccucacacaggggacaguuugucaggaaaucggguaagcccuucgccuuguggagcaugguaguuaaaaagccccuaaguccacaaagguagaaacugcggauaggggacaaggggcuaaggagacgagagugauggaagccucuaaggucaggcauuggaacuuaagauaggccgggcgugguggaaagaguaagagaggacuuagaggugcugaaucauucuuaauucugagauccuacugaaaagucuuaggucuucaacccuagguaaccuguggguggaaggaaguaacauacacguaugugugcagcaagcacgugcauguggaucgauccaucuucaaauugauaacugggaagcgggccaacaaauuaauggugucaccaagucaucuuuuaaaagagacugcuuggauguuucaagauggcgguugauggcgagggggaggggggaugcaggcuacgggauggcguggaaggaagaaaagaaagguucauaacuuacuguaaacagauaauaaaccuugacgucauauaaaaaccaaaguuaaaaaaaaagucuccugacugcagauuuuuagcaauuauaucuuaaaaugacuauauuuccaaacuggagcuauguugauggugaucgccagcaaagcaaggugaggggcagugaggugaugagucagcagauacaggugccugcugugcaaagccagcagcaugaguuccagccccacaacccacauaaaggcggagggagaaaacuaaccgcacagagcuguccucugacccccacgcacgcgugccaaggaacaguugcccugaccaccaccugcccaauguacccacaaacuaagcacuaagggcagguguacucaaagaaguuuccaaagaguguuacacggaguauuaaaauguaaaugaggcauccaaaagauggagacugacuggauggcagaagucucucagaagaccugcgcaucugaggcagugaggacuuuggacuuuauaaguggugaugaguuaaacacuggaggcaggaacuguuaagagaggccacccagccuacauuauacuaggcaacauaaagagcucaaagccaucaggucccaccucuguuagauuuaccuggaacucaguguuuuauucucacacaaagauguuuccacuuccugacccauuucuaaagguccucgcugcucucuaucaccaaauucugaaauugguugguuuuuccuuuaaguuguuugguuguucaacacguuucuguaaaacuaucuuaaauccacccgagcgaacucuugcucacaaacacgugcuggaaaacagccaacaggcaauguugccauccgggcguggcuaugaaaucauuugagaggcugaggcaggaggacugccacuaguugggcuagcuagugaguuccaaaccagcccugggcuacagagugagacccagucuuaaaacaaguaagcaaauuaauuaauuaacaacccuaaacaauaacaaaacaaaaggaacagaaguaaaauacaauaaugagagcaagacacaaagguaaaggcugugaugggcagggcagggucaaauauuccagucucaaacuaagcaucccuauaaaaugcaguauaucuagagcuuuacaguggacucgacagaaagagugcaaggaacgcuuacuuaagccuuuuccuacauccgugcagaacuucuaacuccaauguuuguuuauccaacugaguccacaggcaguaaacugugagaaagggagacaggacuccaggagcuuugccuaucccuccauucgugcuucugcuccgguucucucugucuggaagagagcuacaugcauggcucucugcauuagcuaggcggugucccaggcgcugccgcaggacucuggguaccagaccugguggcccggguggaagcugguaucaaggccaacacugggcggggaaccuagaaccuagguuugcccugcuucaaagcaggucccgacuuccccacucugggaccugggaucuagggguguguaaaguggcuuaagaagccuggccguggucaauucuuacggaugccccaccggccaucccccaggcugccagcccaccggaagagagaagaaagacuagagaacggcggucagggcagauaugaugguugcagaagggcuggcuaggucgccgcccuuagagacccuccacaaagaugccagccccgccccggugcaaaagaccccagagacugcacagggcugcgcucgaguuugcagaugggcuguaccggcgggaaguuguggcaggcggaaaccgccgggacgccccaucuccaucccgccccacccgggcagguggcugcagcuuaccuugguggcgggguccgcgucagcgggaucuccagcugcucccgacgcuuccgcugcgggcccauggccacugagcuccagcucgcucggcgugucgcucuccgccggcugcucggggcuccgcugcucgguggaacugccugcacccauggcucaguggcuuuccuacucucgccggcuagccgucuuccugggaccgcggagaagcagaggggcgaggagaugugcgcccaggaccacagggacuaaggggugaggagcacccgcucuccacgauccugcugagaacac

SEQ ID NO: 12448 - RNA, 163853 nt, Mus musculus
ucgaugaagacauuuuauuuaccuuuccccuagguacauaggugacauaauuauagacaaguuuugauacacaggaaaacccuucugucuaccuuccuuuuuuuuuuuuuuaaauggaucaucacaauauuuuuuuuuuuuuuuacaauuuuaaaacaauacacagcuuucucgggcugaagcaauugcaagaacguauugguauugguauauuacagcuacuuacaauguuuaagaauagcaauggagaaaaauaaguuauuuaaauauugauuucauauacagaaagugcaauguuguuaguugucauauaacuugcuugacaguuugugggguuucuucccuaucaauuuuaaaaaucaagauaacauggacucaagacagaauuuuucgggaaccucacucaguccucacacagcagugacuugggaaucuacuuguguuccaccgcaguugugaaacacacuacuccguguccaggacucuuuucucacagaagaaucauuucuaguuccauccgcaccuggggucgggacagagaaaagggcccccaaauaugcaaggccaugaaaagcuauuugcucucaguaucugggaauguaaauaguaguuugggcagcugcuuucucugcagacagcggagacacaccaaucacacacauucuggguagcuaccugagccgaaacgccuuuccagguuaguuuugugcuuugcaaagacaacaauuuucacugucauucaaaauucuguaccaaaugcaaccgaucaaaaguggcuauugcuaaagccggccgccuguccgcuaacagccacaggcagccccgagucuccucagagucauacgcuaauguucaggcuuuucucagaccaaaugaaacguucaaagcaaaagaaaaccaaacaaauaugauacaaggaaaggaaaggaagggagggagggagggagggagggagggagggagggagggagggagggagggauaagaagccucagccccuucagaucagacauucacacuaaacucguggucccugaauuuaauucuccaugcaaaggcgacaauuuccagagagaaaaaagcuacuguuugacauucucaagaccuccuugauugacuuaaaacagaaaacccuacaccaagaaugaacugaaacuuggaaauucccaaaagauuucuccuccucccugguuaccuccgauguuacuuuugcgaggucucucucucuucgcucagcuaaaaucaaagggcagucuguugcacggucaggccaggguuacuucaaaagcaagagaagaagccuguuuuccaaugccaacccccacaacagcaugugacuggguccuggacuggcagagaacccugcacccccacccauuggguggccuaugccugacccuggaagcuaaccgugagcucuuuauuaagaguccaauaggaacccagugccuuuacucuucucauucuaaacugccucaacuucuccacguggcauuuuauaguaggcgaagggaagugaggaaaccaagcaauauuauuauuuuuuagcgcacacuaaaaugugugugggguggggggaaucaccugagauguuccucagagacguggaccagcuauauaaaccauaaggccaggauggcguuguuauucauaaaaccgcuugcccuucucuucugaggggaaucaaauuguaauaacccaaaugaacuagcggaggacugauccgggccuuguauucaaaaugcuuccacgauaacuggagacuucacaucgugcuugcaagaauaugaagaaaaaacacuuuguaagcaauggaucaggcacaccugucuaagugugccaacugcuagaaaaccagacgccagacaaaaagagggcagaucacauggaaaucaaaguuggaaaaaccaguugaaaauaugcaauauuuaacacccagcggaugugguuuaucuggcuccauaaugaaccuuugcuugaauuaaaauaauuaucuacauaacaaaugagagauaauaaaaccggccaaaauggaaaaaaaauuaaaaacaaacaaacaaaaagaacuuuaaaugaguaaacuacuucccuuuuuagaaaaaaaaaucuuucugaaauaugcaacuuacaauggcuuucugcaaaggugaucugauaguugaugaauggauuuggggauggaugagguuaggauuucacauaaauacugcaacaccauggccaccgugacagccacucacaacaccauggccacugugacagccucucacaacaccauggccaccgugacagccucucacaacaccauggccaccgugacagccacucacaacaccauggccaccgugacagccacucacaacaccauggccaccgugacagccacucacaacaccauggccacugugacagccucucacuaaaggcagaagacugaagggcagucacuacacacacacgugccccucugugagucccgaucgacuuuuacuaaauuauaguuaguucaaaaacuaaaagucaacaugaaacgugugccugguagucacccuuauaaaauaagccauguuagaaugagacuguuuuuuuaaaaaaaaaggcuauuuuugcuggaaacaucccaaacacguuagauggcagucuaagcugaaaaucuggaacuaggguuaaguaagggcuguggacacuagauagauaacugguuaaaaguuuauauuaaggcaaauaaaagcuaauugcuagaaagcaauuaaaaugucucuggucguuuaucuacaggagaggaggaccguucuguucuugauagagucagcuguuguagcuuuugaacaaaugagcauggucaauaguauacaguaacuccagagucuguugcuuuggccuagcuaagcccaucgggcucgggcaucgggugaccaacagaugcgcaagggcacgaucagacacgagccggcugccucguccuccuagcccucugacagcacaaagacagacuggacacacacuguuuguagugucuuggcucuucagugccugaaaacggaacuaagugcgugucuugccuuugggcaucaaagagaaucaccucgauuuccucgaggggcaggggaggagggcuuuaccggaagagaggggccucgguucugagucccaauccugcaguucgugagccccgagagaauacuuuucuucaaccccagcagacguggagggauuguaucggcuuccuaagcacagugagaggcuggcucuugucuagggagggccacgccggccuggcuacauagccucagggcuugguggcaguuugaagagucuggcugccguuaugaguuuccuuaugugucucuccucggugaugccggccuccugaaggcaagagugggacagggaaggcacuuggcucagcgugcugaacccugcgucagaaagggugcucguguacaugggcaggccgauagagaugagccaauccgacauggacgcaacacagccgggagagaggggcuuucugcagauuuccgucagcccaccacucgggaucuguauaaagaagaaaagccaugucaugaagauugcacaagcaccgugaguuaccuuuugcauggccaagggacauagaagugcaauacaucacugcuaugagacgucaaagucaacauuaagaacuuugcucaaaagauauaaaagacuuuuuauagagcuaccucuagaagauuccagaaggaauuucggacuagaccaaauuccaauuuccuguauaaggcuccaagcuguaggcauuuacgucuaucuuguuauuuugucuccaugaaaucccuuaacuaaggugaacuacagagacaaacuuguaugacaguguaaaaaagauacucaguggguaguguuucuauaaaauguauuuucuacuguaguuuugacucuauauuaacaaccagaaaauuaaacauuuaaauguacaucauuaaucaacaauuuaaaauauaauaauauugaguugacuaggacagagaaaaggaccugaaaccuuauugcuaaggcuaucuuucugaaggagauuugcaggguguaaaagccuacacaauauuguacaauugugcauguacucagauucacaaaggcguacaucauaugcauggaggccagaggucacguuuccacguccuuacaagagcuagucaucuuuuauuuugaaacagggucuuuggcuuucaucuggcacuugguaauucagcuaggcugggcgcucagugagcuccgggaucuacuugucucuccuucccucugcagccacacacaggauuacaaguguggaguuuuuucacaagggggcuagagacaaagcuuaaguacucaugccaauacucuuugcucagacagccaucucuccaacccugacugugugugaucuuaaugaagcaagcucucacuagcgaauacauccucagguauuauuggaauguccagagguguguuuuaaagcaagcugccuuucacuacauaauuuaaaauacaaagaaaggaauaaacccuaaacacuuauggauauguaauugguuaagccauagaauauccaccuaauaaaaaucuugaaauccugaucaugaauuuuuuuuuuuuuuuacuaagacagacacaggaucugaucaguaaaaaccaucaggcuuagaacuguggugccucugcugcucaugcgcacagaaauggugugguuaaaacugagcagcagaggucugauacacuuagggcacacagcaugguguuuagagaagugcaaaacucacacaauagcuaagccaagcuacuuagcagacauccauuacuucgcuaauccacacgccuuuuucguggaauaagaauacagccgcaugcaucagcaucuuccuuccgccaaggacagagcacacucauguccacugcagugugugugggaugcacagagcucgggaaugaacuuacuuauuugguuagcauuugguguccuguguauggauuuuaaaaauagguguuccuugugcugaugggacgaaccuccucccuuuuugucuuucuagaacugucguagccuuggucauccaagaauaugccugaagccaggcggugguggcacacgccuuuagucccagcacuuggguggcagaggcaggaggauuucugaguucgaagccagucuggucuacagagugaguuccaggacagcuggggcuacacagagaaacccugucucgaaaacaaaaaacaaaaacaaaaacaaaaaaaacaaccaaaaaaccaaaaccaaaacaaacaaacaaacaaacaaacaaaaaaagagaaugugccugaaaucccagcauugaagaggcugaggcagguagaucaccaauugaaggcuaacuugaccaugucucuaaguaaacaaauaaauaaagcaaaacgaagaaacaaacacauaaauaauaacggguugguagcuuagugguagaguccuguucuaauaggcauaaaacccagaaaaauaaaauccaagucuaggcugacaguauuauuuucuccccagguuuuuuucccuagguuucuagcaagucuuuguguuaucaaugccugccaguaaugaccucguaacuagauauauugcagaaaucuacguggguugcucaccgccauccgauguugcuuccgaagcagcuucacccggaucugguccauguugguggcaacaucccucucaggcugcucuagguccucugcguaucucuguaccagggcuuccgggaucccacaacggccaugcugcccagggaaagagaaauguggcaucaguggugguccagacauaccccaccuaagauacacagcuuagcuaucaggaaguaacacccgggguuucagcucaaaaggaacauaacccauuuauuauggggcagguccugaaaagaagcugcuuguauuuucaccuuacaaauacugaugagcucuacagaaauauuucaaauuagaauuaggacaacacaauccuguguuuuccaggccaacaccuuaaacccauuuuuauaaaauucaauuccuuagccaaaccauugcucuacagacacuauuugcccuucauccaagaaucacaccgcuacaucaccaggccacauuacaacucucccuauuuucccuucaaaggacacagucauacauagaguaucaaagaggaagaaaagaaggaaaggccuggggcguagggggugggguggaggagguguucuuagguggcauucaugaucauaaggauuuaauaacaaggacucuuggggacacauuauaacagaagaugcauuuccagaagaaaaguauggccaccucuauuauuacugacuuaucuucaaagucgcuuugguguugauagccuuuuucucuucucuuuucaaaugagaacugcauuucaguaucgauagaaauguuuuugguacaccagcgauuuucauauuaugcccccacccgcuguucuauauagauauuuguauaauuacugcaguacaucugaacacgguucugaaccauggugcuuuacaauuuucuauauaugcucccauuaaugguauuugcuuacagcaagcugucuaugaguagauaaugcaggucagguaucugaaagcacaguuaaacuauacagaaacggagacacaaccugcugugggauaaugcacacuagauucgggucucucuugcccaucacaccagccuaugagggucaauucuggugcugauccuguucccugaaaagcacagcugccacaaacuaaaaccaaguaagagaaaaagaaaaccaugaagcuguguuuguauuuaauccagggguagaggguuguacucccaguucagaggccauaggcagaaugaaccacguggccugcagagcacaugugaccaaggccuuuccuggcucucauuugaauggugcacaccuuuaaucccugcacuugggaggcagaggcaggcggaucucugaguucaaggccagccuggucuaaagagcaaguuccagggcacacagggcuacagggaaacccugccuugaaaaaccaaaccaaaaaaaccaaaaggaaucaacaguuagggcccugagacccaggccucggauaccuuaucagaguagggcuccucagugagaucaaugcccuccgccugcagcuuguucuccgugagcaucucuagguccacaccccggacacaggaaaccuuccugcucagcacugggcccaguuucacaccaugcuccugcaggcuagugcucucgggcagcucagccagccaggguggaggucucguacaggcugggcugcccggcucagucccggaggaaggccuggguucccggggagaggggcagucgcugggacugacugggcuggcagggcuggcuuucuucaguggcaggaugggugccucugggcuggggaccaagugcaggccauuggccaggcgcucucggcuuuucuuggcuggcacaggagggggcugcgacggaugucgggacuguguccuggucucaggggcgcucugcuccccgucuaccccuucuuuggugcccaggggguggugaucauguccuuuucugagacccucaagagacguccuuguuaagccggguuuaacaggcggcugggccucgaaaucucuggguauacacugaggaggagcuaucccaagguuggaggccaccacggagccauccaguuucuuagccauuguuuucggggggucggaaaaucucuugcuuugggucagaagcaucacaucugcugugggaucucggccucguggcagagccuuggaggugcaggcagacgucuucugcggcacuucugguacauucugagaacagguuucuggcaucucgguaggcacauucuugccaacaucagcaucucccugaaggucauccagggaaugggaucggggccaacuuuccacaggcucaggacccuccaggguuucacagcugcgacagauggagaccgggaggcuccuucgguuuuuacucaaaucagucacagagggcacgucacagcucuuggcaguguccggggcuagaccucgucccagccugcccuccucucccugcuugcgcaccuccccugauuucauuaaaggcaaugucggguaguugccuggcugacuccuggugaaagacuuuaaguuggacuccguggacgacuugguagacagaacgcuggguuugugaguuuuggcuaugagagaaggagauuauuuuacaaugacguuuuaaagucacugaaacugauguacaaacaagggcuaggggacacugaaaaaaaaaaguggggugauuagcgacccauuuuuauuuuuaugaagaauucuaguuuauuaaaguucuaauagggacugaaacuaacugguuauguggaaaagaaacacugggucaagcagaaacagaaggccagggcuaaugucuaauccaagcugcuuuugguaaggaaagacuggcaaugcacucagaaaccaagccauacgaucuccguuuggccgauauggguuuucugaagucaggguugaacugguuccuuagaauggggucugugaaugguacccacgaaggggugaucaaaagaagaggaacaaaacuuccaaucauucucuccuucaaagcugcucuucuugaauaaauguacccagaagcaaggaagccaccuggauacggaucaguaaacaaaccgaagggagaguuucgucagagaccacuuacaaaaugccgacucauaugcuuccagcacaguuacuguccuaccugaacuaucagccugccauaggccacuaacuugauaacucuugauugguauuuagcugcggugugacaagcuuucuggggaauaugcucuauguaggcucauguguagguacuggcaagaaguucaugcgugugugugugugugugugugugugugugugugugucugucugucugucugucuguccacacacacacacacacacaaaucaauggugcuuugucucuucuuuuguuaauaagacauuugcugugucccuaguagcuagucugauaaaccugagaauauuccacguaacggauuaucugagccacgugauuaaguuucucgagaaaaagagauaaacaccacacaucuucacaaggcuugcaaaauacaaagauggucugaucuauggaaaguuaguaaguuauuaauauaacuaagagauuuuuuucugcuaaucuaucuauaagcaaacaucccgaauucggcauuucaguuuagaauccugacucucccccauuaaguaacacgacccuuuggauauaaacaugaacagcagcagggugaaaucaggcugcgggccaauuugauagggagggaaagaacaugcguuggguggugagcacucaguaagaaaaauagcuacuuuagggcaaaugaaggcauucuuugauaaaaacaacaacaacaacaacaacaacaacaaccucugugugaggcaaucuagaugaaggaaauggaacagaaagacaagaccugaggcucuggcauuccaagagcuuugggcccucaucagcagggagaaagaguuuccuuccgugauuucacagcauuccaagcucacucaaaccucaaacugagagcaugaaguguugcagaccccugcagacccuaagccuggcagcuaagcacagugcuuuccucaugcuagacuuuuuauuagugaggccaucuuuccuggugagucccacaucagcauaugaaauucuucaugcccaccaaagcggagacgcagacaaauggugcgguguccucagugaggaagaagcucaaacugcaaacucugccugccuggauuuccacgcucaucaacagcgacacacuagcccuuucucaauggguugcuauucuguugauaaauggagauacuagcuugcuguuaccucugauuguacuggcagcauuucuuauuaacggaaagaucacuacagguaaaugcagcggggaaaucgcucaccaagcacaucaguuaagauggaaaacucuuucuuauuaaaguccauugagcucaaauggauuuagaaauguuuucuucucuuauuaccucccacuaugaaccauauguuucaaugccagguucacauucuguuucauauagggagagcucugaguucaccuuugaaaucaaaggauggcucaccaguuuauuuaauucagaucuucaauagaaauaacugaauuccccuggggacaccaaacccuuuggcauugccaccuuucuuccuuacuaacccagcacuguugggguuaacuuuaucugacuauuucagcuauagaaaaaguuauuaacaaaaacugaccaaaaaagccuuccguauguaugcaaggauuugcuguuugcuauccaggacccagugcagggcuccuuaauguguuuugccuuguauuuuaaccaaggcuaucuaaacguuaagcaucagaggacccauuuaucuucccaaauucauugaacauucuggguggaagagcuuauggguaaauuucucgguucccaaugugcuuagcaguaugaaguaggcaauauguccagaggugagggcuguaagaaugugguugacuguaccacgagaauuugaacucaagccuuuauuuaccuuaccuuagagcuggucugggugcccaaaauaacucucccaacacuauuuuuucaaaagcaugauugacacuaagaaacuacguuuuaugcccaccacuuaccauacacaucugaaacaaagauuacaauaaugucacuaaugauacuaagccuuaccucauggaauaugccgaugcuuucuauaguguccuagaaaaccguuguccagggucauuaacugauuuccuaacccacuaacaaacugcaaccuauggcuugcuucaguaaaugcuaagaaagagucuaacugguuacgaagauugcuucccaacuguucaaagauagaagccacaaauaagacacguggccuucuagucacccucucuagggguaacugucucuggaaucaggcugcgcggcuacaacauacagcugcagggguucccugauggauggucuaccuggcaaacuguuuuucuugugggccuaaucgcucccaguacugagaugugagugguuagugugugaagaaaagggcacaggagacucacaauuuagguuuuauggcugaagguacuuuagacagaauuuauaaauguagcacagagcagccaggaggacuagacagaguagugggggacaaggccagaaacagaaaguugaccacuugcuucauauccguacaagaaugaagccuucggagacacuugcaaugaggugacacugaggcagguucugggggucugggccaacauuaccguuuuccaaguucucgcugcuuucguagcauccggagucucguggggaucguccacucaggcccugguuguccaccagcagcuuuuccugagaaccggacuggucacuguuaccuggaggauggauacacagcaugcugucacaaggaaccucaaagucagcucgaucuucauccucagcuauuggcacauguuaaagcugaacuaaacaacaacaacaacaaaaacaaaaacaagcaaacaaaaaacaaacaagcuaaccggaucagaacaccucuccugaaguaacguguccaccaugugaaaauaaacuuggcgagagaaccaggguugagacaugcugauggguuugguuaaacagugggagagugaggcugcagaggggaggagaaacacagagugugcuacugugguacuggaggaggagagcccugcagagagauagcaccaucaaugagaagcagugugugugugaauuggaccuuuacaaggugggugcgguucgaugcuugucagacacauggaagacuuguauguugagucauuuauguuacaggcuuuccaaaucugggagcuuagauaaaagcgacaaaugaaauauugcuuuauaaguauuggggaggauuguuagccuacaguaacaauauguggccaguuauaucaucucagccaauggaaggcuggugagagaggaacagagcccuacgcaaggggaaacaaagcuuucaucuucugcaguguucaaaguuuccuuucucuuuacccuucucccacugccuugcauuucuauucccuacaucuagugugugaagaguguucaggagacccucugaccaucaagcaaaggagcuggccagugcaaauggcacagccccagcuucagccgccccucuacaaaguagcaucguuauuugucaguuggaccucaguaaugguuggagaaagucaggagacaaguuaacuguguugcugauggagaugacuuccuggagucaaucccauggagucaaagccacgugaguggucagaucccaggcugcuguguuuucuauagagggagcccagggaacccgggacacccagguuucacagaacaccuucagauucuuauguagagaaagcacuuggucacacaaaacggaaaccauagaacauuuuuuuuucuacauaaaauagcuaguugcaaagacaaauggcuuuaauuucuuucucucaccugcccaucccaaccacacacacaaagaaaaaucaaccaaccaaucaaucaaucaaucaaucaaccagaacuaugaugcucaggaaaucaaaaagagcacguggagaggcugaguggugccugccagccacacaugcacugguggggucccaccaucgucuucccacuuccugucuguauuucucaaagggaaagcauucuauagcaugcacaauaccaaagagggugucagaagacauucuuaaauuauagccccagagaacaccaauuagcaaacgauugguguggaaguuaacaaaucagaagcacaugagcaaaucgcaccccucccccuaaagccaccccaaacugcgacaauccauggcgacgaccucauccuguggaagagccugcagguuuggauuggccguugcucuugucuagcaugcuauuuaggaaaacgauccuuggaaauaagggcuucgagcugucuuugaguacccugugagacggucauuccugucccugguggcagcaguucaggguugcggagcaacagagccgacuacagacuagaggcuacaaaagggaagcaugccccgggcugcugcugagaagugcauccugggaccccagccuuugcagguacugcaagguccugcucuuacagaucucuccagugcccgagaaccacggugcaauugacugucauaaggaaaacaucugauggggcuaaagcugccaccuucaccgacucuuucauguaucuagacuuuucucucacaaucacuagccucaaugccaauguagggagaccaagaccacgaggaauaagccaacugucaucaucaaaagggcugaagucccauuuggucacgaccugaugggucucagcaagcuuggucugaacugccucccugccacacccacccacccaugugagcaugcauaggugagcaugaucaggggcugaauaugcacugacacagagauccucaaacgucaaaaacacuggcauauaagagcacaaacuggcuucuagaaggugcuuuucucaggaaggagaggggaugggacuccuggagggaggccccuucaaaggcuuaccacauuuccuacacugcacaccagccauccauuuuauuucucuccauacucccugcauacuucaaauaaucuuuaauuaagagucuuacaaaaacaaacaccucuucuuuugagucggggucugucucuguagcccaggcaagccugaguaauccugccauacuugcgucaaugcucacuucccucagaaacaguaagcugaggucacaggcggucgccaccacgcccagcuucaaaggcuguuucuacugagcugugugcauggcgguggucaggauggcaagcucuaugguauauggauuuuacuacaaugcuuuuuuaaaguaaauuuuaagaguguuuuuagaggaacugaaagagucuaaggagaagcgagcugaccaucuuuuccaaacagaaggcugagugcagacuaccaccuuucuugccugugggagacauugggaagguuuggcuuccaaacaauacuggaaauacacuuaauacuuucaguggaaguguaagcuaggagaacaucaagauguccuuucauaucuucaagaaccucacuggaucucucuuacuacugcaaacugaguucggcagaacacuacugugguucucuaaguuaucaagguacuugcaggaaguauuucuuaaauagaaugaauuuaacugcaugaaauggaaagucuuacaucacuaggcgacaucuggauauggccucucaacaguaauuagagcugcuaagcccuggaauccuuuguuucaagaucaauaaaaggaaauaccauuuugaguaucagagaaauuccaagcagugcaaaugcacagacucaaaaugggauuuaugaacaaggagucugccugagccucccaaguuagcauccuaugagaugauucugguacaaaucuugggaucugagccuaggacaaugggacuaagccaauguguuaugucacacuagccucagaccccugccuguauguaggcuuuagcuuugcucuucugacauggaaaugaaacaggaaauguaaaggaugauguauauaagccagcuguccuccguaaagaguaaacgacauagaauucagagcagauguaguucagaagaacagauggcucuacauuaauccauauuaauggggcaggucugccgucccagucagucacaaggcaggcugcuuccacacaaccugaccagagacuccgggguuucucuagagcagugguucgagaccuuccuaaugcuguaaccuuuaauaugguuccucgugugguggugaaccccaaacauaaaauuauuuuuguugcuaguuccuaacuguaauuuugcuguuacgaaucguaauguaaguaucuguguuuuccaauggucuuuggccauuccugggaaaaggucauuugacucccagaggggucacaaccuauuguucuaccucuccagcaaaucaaacgcuauagagaccuggucacgaagcaacauggcaaggaagaaagaggacacccaccaagcauagaccuaggcugucuguguacucugucuauuagagacuuuuucugaugccaugagaaaaugcacucauaaaaaguggcugaagaguuugcuggggauuuggaguaaagcccauccugguggggaaacggugggugcaggcacuugagcagcugggccuguggcauucaccgugaacggcagagagagauucaagcuaauacccagcucacguuccccucucuuuuauuccaggaccccagccuaugcaauggugacucugucagcaaaggcgggucuuuccacuuaaacgggccucaccuacacaauccuucagagacaugcuccaaagccaauuuauccuaggacauuuccucacacaaguguccagaggcuugucgccuaaguggccucgaugaugucaagcucacaauuaaccaccacgucuaagguucagacuucucuugauaguguuccuccauguuacugguaauaauuuaaagagugaauuuauuaauacagcugcuucuuuuucucucgggucuuauguagccaggaaaugcaaaugauccuccguuuacgacggugcacucggauauuauaagcuaagaugcccuuaacucgccuaacccacugaacagacuauucugggacaccacccagugcuagccacugcccaucauggucucagagguggccagggcuccagcucacugcuacuguucagcacuauuggugugcagacugcacacugcuuggcuagaaaaagaacaggaaccagaauucgaaguauaguuucuaacaauuguguauugcacuccucacaucagaaaagcaagaaaacccuaaguuggagaccguuuguaaugugcgccuucaccccaccauuaccccugguucugaugugucuuucagugguagaaauccacgggcuacuuauacccuggcagcagagcacauaaaggaaaugugcuuggauuuaagaacuggaaaggauacauccuccauaaugaauacucagggcuguuuuuaugucagacugaagaauaaggaccaugauaagccuggcuuagcagggcaacagcaaugggcacaacaaaacccacgaauguccugaauucugugcacacaguguaaagcagcagcucccauacuggacuugggaacuccugauccacacacucacuucagugagauacuucugucuuuccuggaaacugauggguuuauuuuuucauuacuaagccuauucaguaagaaaacaacccacacuuuggaaauaauaaacccuuagaugggcaaagagacuccuaaauggucagccuuucuucccccucuacuuaaccaaggauuuuuaggauuaauuauucauuuuuuguaugagugcacuguagcuaucuucagacacaccagaagauggcaucagauccuauuagaguugguugagagccaccauguaugugguugcugggaauugaacucaggaccucuggaagagcagugagugcucuuaaccgcugagccaucucuccaggccaaccuagggauucuuaauggaugcauguuccagugggaacaacggggaaccuacugucccuucagaaagccuguggcacucuuuucauacauacugacaggcaugucugcucugugaauguauugucauaauaugaaguuaaccuuggcuuugaaaagaaaaagaccaacugaauacuucugguaccccaagcacacaaugacaacuuauuggaggcccguucauaaucauaaugcugcugucuaucuagcagugugugugugugugugcgugcgugugugugugugcgugcgugcgugcgugcgugcgugcgugugcgugcgugcgugugugugugcguguguguguguguaugcgugugugugugugcgugugugugugugugugugucgcgcaugugcaggagcuuacugucauauuccugcaacagcuccaccgcagucagaagaacugcucuguguucugggucccugauauuuaauucaucuaagucuucuuccuccaggaguuugaagguguccaggucuucauagccauugaacaggaaggugggcauguguuccugggaggcagagcaagaagaucaacgugagucuguggcccagccaugggacccaugucacacagccagccucagacccuucagacuuuuucccauaguccuuaugcucaucaagagaugaguaucauguauaauauauucugggccucccugucugccagcuuagcaggcagauggggguguauaggcucacucacuaauggcuuaagaaggaacuaauuccuucaucaccacuuggccuguagugagaagcuuccccuuaacauucgagugggggagacuuauuaaaauucaacuuagcaaacccugugaauuucucaggaccaagauguuuuacaaguugaaaacuagaaucuaccaugguagccguacgccuuuagaagaugccgggagucauggccagggagagcugagaaggccucaugguccucauggugccucaugguccccuggagcuggcugugagcagaacacuuuggguuguucagagcccuccaaaaaagcaaacucggaucuagggcuuacgcugcgcuauugcccuuagugaagggcaaggguaacguuagaauacugguaaccguuuuuacugaauacucguaaccuuagugggucacaccugcaaggugacaugaucacccauccaguuuagagagaggacaagcgacaaggacacaggaaggacaagaguaacaggcgacugacuuucagguugauccgguccaggagauccuccacagacuucggcugagauggucuucccuucuuccuccuccugguagggcgcuugggcuucuccucuuccucauuuagcacauccacguagaugaacuugaacgugccgacuuuguuguucagcaggcccauccagguacccaugggugguuugcuaauuaugucaaugauaucuccuuucuguggcccagggaacaaagaucuuuccguuaggcagcugucuacgccugagcaaugacauaauucagaugguuggggaaaugcuacaaggucaggauuacagucccagcuuccuuccuaucuaauccugugugcauuuauacgcaugugccaagcauucauguggauaugggugugugcacaugugcacauguggcaaccagagauagauguccagugcuuuucucccuugcaccccgucuuacuucugagaguucaucagaugguuagacuggcuggccaaugagcuccggggaauaccccaccuaugucuacauccacagcacuggucuuacagaggcacaccaccauccucaguuucuccauaggcgcuggggaugugagcguagguagguauucaugcuugaugcucaagcauguuacugacugagucaucaccccagcgccacaggucaccauucugagcggcugagauaggauaagauugggaguuuuacggagagcagaucugauacuuuuaauugugcuagaugccacacugaccccaggucacagccuuccccauuuccugcucagcaggguagagcaggccuuaucugucagccaugcugcagucagguugccuaucuuggcuguuggaauccuugccuccaguuuuaagaggguguucccuagccuguggccacaaccuaugaacuauuuuccacugcaucuuuagaucccacauaaacaucucuguacacacacacagagcgguuauuccccucagauaaaggaagcauagaaggaugggcauggaaguucucgaaggaagcuggggucaaaggguaaagccaggggaggaagcgagagagcuaaaacacagcuuccgcauccuucaucacagucugguucuauuuuauuuucacuagaaaggagcccaguguggccaaaacaucaucuggucuacgugauaagaguccagcauccauuggcagggaagagagaagcccuuccuggaagacaggagggccuggguuagcugcccaagaugaacaagccuaccuugagcuucagagaguccgugucauagggacugggggugaagucagugugcacucgggcacgcccacagaagggaccccgauaggguggcucuucgucauccccaucuucugacuugacacucucccgguugcugguggaggaaucaguggugcucacugucugaccaccuggacagggagagcaggaagcacggggcauuaaacacagccuucccaggcagcaaagaugaaaggcgccaacagcacugugcaucagauaaggcccaggaagggaagcuacaagccacagcauucugucagggccacagccaggccuaugcgugagccuucugcuauccuaacccagcuccuaacuugacuguggacuuccagcacccuguccuugugacaccgagacccaccaggggaggaugcugcagcguaucgcccuagccuuugucuauagcaugcaacaccucauuuggaguacaccauuucucccucguauuguuacagaggagggaacaacccuagcugugaagugcuugccugagagagacaacuuaaaguucugaauuugaccuuacuucuucguuguuuggccaacaccaggugucuuugguccuggggcagcugaguuauauuuguaucaggaacauuuaggauucugcugagucauauuuguaucaggaacauuuaggauucugcugagucauauuuguaucaggaacauuuaggauucugcucacggcacagaccccuguauuuuguuggucaucuucaugcacuuugaccuuuggcuuauucucuagguucuuccucagagauaaauuuucuaucuucagcaaucaaaaugaaaacaucucucuuuugcaacacgguuggaggaaucuauaauagcauccuaagggcaagugcuuagacuauacucaucuuuagcuugccuuaauuugaggcgcaaaugaacaucugucuggaacuccaaaaggaagccaugaugaauuacaaaccacacuuacucauugagcucuggccacucagagaacuccgaaggcuuuccacagagcccccggcuuugagcuuaggcuuguccacguguucggagucaggcuuuccugaggcgggggagcugggcauuccaucgagccccgaguccugaaacaguuucaguagaauugaguuuucugagcagaaagguuauguuuuacuuaucauagucguugacuugguccucaacuuuaccagucaaauugacauacaauagucucccuuuaagccuaaaucuuuguuuacaucuaaauauguagcccuuaggacugcuuauuaagugaccccaaauuguuuucaaguucaaacagguauucuuaaauuuucuaggaaaacucuguuuaccauauauaaaaacaacuaaaggcuuugggacuuaguacagcaggaacaagcugggccucaaauguaggucaaguucagucuacucuugacguaauauuuagaagcacaaccagagggcaguuaacuaacucuaaggggaaaacaucuacaauaagaaaaagcauauuucuuagaaauaacugaccaggguguuucuauuuauauaaauuguugagugacuggaagagggagaugcugguguuuacccacuagggggcagcagcugagcaaaaaugcuuccugucccagcuggcugcauuggcuagccggggcaacaacauuccuuguauacuucaagcaagcucucagcuugagcaugucaaaggaggagaagguuuugaaaccaaaggucaaaacuaucucaaaguuuagaccuccaaauguccuuccuuccuuccacaugugcaguuaacacagaaacuggacauguuucuaaugaugaugaaggugguuuucuauagaagcaggggugagacgucagcuucauauccuacugaugacauacaaucccaguaagugagacagccucuccucucacccccuauguaagcccgaaagacuaacggaaucuaguagccagaaaggauuguguaaaauuccuuguuagaccugcugcauacaucuagaacaguauauccuacaucugaaaagacagcugacagacaccacuuuaccaaaaaaaaaaaaaaaaaggauuuacuaauuuuuacuuuugguauaugaguguuugccuacauguauguguguucaucuggugccugcauggccuggacucccuggaacuggauacacacugcugugagccacuauguggguguugggaaucacacccgaguccuuuccgagagcagccagugagugcucuuaaccaccgagccgucucucuaacuccgaaggguucuuuuugaggaggcacccaguaauagguaauucauaacaaggguguuuuagaaaaaguguccucugguucugccuugugcuuaaauauacccacuagcuuuauucucucgugcuagaguguuugccgcacuaagagccuguuuuguaaaacuguggcccugucuuggguucucugaaauggagggccuacugcgagcguuuaucuugucaaucuuuagaaccaccacagaaaugagccggcgggugugccggugauggguuuccuagacuucuuaguuguggugggaaggcccacccuacaugugggugaucucauugcaugggcagggguccugggcugcacacaaaggagagaggaggcugaguggcggcagcagacaucugugucuccuuccugauggcaggcauagggugaccagcugacucaagccacuacuuagccagucaugaugcaccaugucuugaagcugugagcuuccuucccucaguugccuuugcccuguauuuugaugcagugaccagaaaagucacugauacacagggucuguguuucauauucccagcacugagaacacugucuggaaagcccugacugcuuaaugaguguuucucaaacugccuguuuuuucuacacaaauacagccuggucuaguggccgguuaaugccaaggaacacauauucauaacaccauucaauagccuaggcagaccauccccagcaagaacguggagcaagguggccacauaccugcucugagaccgggcugcuguacuuuuuagacauccucuuccucauggucucuuucacugaucucaccuuuuucccgagagagaugcggggggcaggaggggauuugaugacuucuuuguacacaaaaucucccucuuuacccugcaaaaacggagcauaaaugccauuacuccuaggagauaaggcuacaaaccaguuccauuacucaaaccauuaaugcacuagaucucaggaaaauauuagcauuccccagcagggucacacaaauaagagcaaaggcuuuauuuaucuucgagacuaggaauuaaaaucuaccacgaaguauuuuguugccuguuuauacugggccugaggcacuuuuuauuuuauuuaaucuuagugcaugcuuuuccaauuauguugguuuuuuuuucccccuaccauuuaaaaaacacuuggggggcugcauugcaucauggaagaaggaccuagaggguccaguguucaggaaaccucagcaguuggggagacuggagggguccauacugacucauccccagggcaggaggugggugugagggcgcuaucuauacuaucuaccaagcugcacaaaacugcuugguauggccaacgcucaagaguguaacuuguuuuucugaacaagcuagacuguagccaccucuuguucuauuuugcauuaaaaaacaaaaaacaaaacaaaaaaaaaaaaaaccuuccgaagacaggauaggugggugagagggggguuucuguguuuuuaaaaacugacaacauaaaauuauuggcuuaugaaucaauaaaacuugauacccaaaaaccacagcuuaaaucuuguaagaaauuccuaacacuucauaucucacagaugugcacucuggcugacauaagaucauagcuauaaagcaugagcucuucauuucauagucucaaggcagaacauuuaagggagaagcaaaaccacggaaagcucaccuguccccuuggggccugaauuuugggggacuucaaacacuaccacaguguccuggcccuggaccauggcccauaagcaugucugaggagacaugaaccuuuguaaucaaggcccugcuuugcuuugacaccaagaaaacugggcucgugucaggacagcucccaugagaacacccacucuuauugcaggcuuuguggugcaugcacugguccuauaauaagaugcucacugaugcccaggucacaggguucccucagaucauacaucugggcaacugaagcuagggaggagggaagguucagaggcacaaagcuuaugugcuuuauaaagcacauaaggccacaggagccaaaucuguguguguuacuuacagaacgcuggagaaagggcaguaaagaacuaaagguguccugaggagauggcaggcaccggagauggguggucaucagccaucccauggggaauaggagacugucuccaagauugggagcagcggagcuucacugcaaacacuauuugggaccacugugcaaagcuggaaucaacucuccaagacaccaaguggggaguuggggaggagaggcgguggggagggggggaacccaggucacugcaauccgguacccacuucuuuucucuguggcccacuuaccgcagggucagaauuauuacugccaacaugcagagaacgguuugucaggucgaauccaccaaaacugcagguucucuguggaaacgagggggaggguagaaacaauccaguuaugcucauguggcagccacagacaccccgacacgugucccccggugcaaggcaccucugacucacacguacauguacaggauggaaggggguaugagacaugaggaggagaaacaugagaccuuucuuauuugguguuugcucaggccacuaggggucuaaaagucccuuaauaugcaaagccagggacucuaagaaaauagauaaacaaaccuucacaaauggagugccggaggaagguccccucgccucucugugaccuagggagugcugugcucugucauggacagcaggccuuucugaaugauuuuugucuuguuuaguuuuaaaacaccgggcagggcaugguuauguuuaaagacaccucgucagaccaaaagggguccucacuaaacgccccaccaagccuggucaaaaaugcagauaaguuucccaucuaacuguuccucuggauuacuucuaaccccuuuucucacagcggauggcgccccauuuguggugugaaggugguggaggggcugauggcgugucugucauugaccacacacuuagcuuucagcaggaaaagaagcuguuguaaaaacggaugaaaaguucauuguacuuuuaaguuggcuucaaaauuugugaaacuacuuaauauuucuaugaucuucugcuucuggaacuuguaucugauuucucuuguuuuccuagcaauuaaaaaaaauaaaaauucauucgacgcccaugugggucuucuuucuccgauauauuuuaaguuuuguuguaaguaacacuguaaaggcaguugguaggaaaaccugaauggcagauuugggcucugaugcuaugcgugugaccugcugcucagagaccauaacggcagccacaaaacgggggagauggacggaaaagcagaauucauacuuaagggcugcuucuuuuaaccagguauacuuuagaccuauauuaauguacugcaucaagaaagcagacacagucuaggaggaaaaugagucggcuucuuaaaccccguacacagaucuaacuucugguucugccacuugcuuugcugugagaccacagcucaaguguuaaaacucugugaccgugggguucugcacugagauaccauuucgcaccacacaucugaccacagcacacggcuggucauaaagcagacacccuggagauugcauuugcucucugcugucucauuuugggucugcugagaggcuggaagcucacuuugauuaguaggcuuagucaagacuauaaccguguaggcaaggcgaggcguuggacuuccuucuggguuuuauaaucugggaguucaauaguaaaaccaaagcacucaggaaugggccauacagggagguggcccugguggcgagugagaggaacagaagacgcccgccucacaggacagugcugcuuucacuaauccuacuuacuuauucccuucccagugggaguucgcucaacuguauacuacauaccagcagcuagccuugcucucuuuacagucaaccagcuguguccaguucauaaaacgagaaagacuucccuauagaaaaccaauacagcucaccuaaccgggcaaggagaucacggcccaccucaaggcaaacuuucaacauuaacuugcgcucauagcucguggugcccucauagcuuguggugccaaaugcguguucucaguuuugcaaaggcagggacuuuacucuaguuccuuuccugugacucagggcuucacagacacaggguggcgcccagaugucugaucacuguauggcuuuugcacguccaugcguuaaaugacaacaucuccuguaacacuggggcccagcgugcuuuccucugaugcgcaugaaauaacgcacaaggaauguauguggaaacgaugacuguaauaaauuagaagccuguugagguucuugugugucugcugcaugcauuuauaugccacagugaagggcuugaagaacggacuaguuuucagaagcagcagcuagacucuuuccagguuguaugcuaagauaucggagacagguuccuucccaucgcucaguagagggcuagaaagccuggagcauugaguggaggaagcucucaugucucccgcgagcaccagcucuuaaaggagcagacuccuuccagaggaaaaauggauuuaaaaaagcaaugaaaaaaaucuuugagcucuggugaucuacauuaaugaagcacaaggaaaaauuauuguuuucguucauucauggcuguacagauaauuauaaaaucguucucuggcugaugcuuaggaugaggagagcgagccaaugggaugaucaugcacugacaacauguugggagugagacugaauuccaaagggacaagauuccaaggugucaugcaagucuguguuccgaaacaaaaaaaccaaaaaaccaaaaaaaaacaaaaaccaaaaaacaaacaaacaaacaaaacccaaaaaacuugaaugaauaaaaauuaaaagcaagacacgugacuguuuccacugaauuuaaagcguuaucauuucccugagguuuggucaagcaaguauggcaucucuaaagaacaaaaaagaucaaguuugaaaauuaaagcaaacugugcacuuuaggguaaagugaagaaagacaacgggaacagaagggagcauuuuacgugagagaagaaagaaguuagagaguguagcccagugguagagcucuuacuuaaacaugcaugaggcuguggguucaagcccaguaagaaauaagacagccaaucaaaaaugcccaucacuuucuacucuuaagacauugacuuuagccuauguuauccaaguaaugaggaaauuauuuuuuuuucuaauuauacaacuguauucacaagaguggcuaugcacagauuucuaauuuggguauuaaaagugcccaguacugucuucagcucuuagcaucuuaaaagccuccagcucaccaugccaucguuacugaguggugcugauguuugaaagccagcuggcagaugaugaaccuggcucaacucugacaccaagcccaguguuuuauaaaagauaugaagguuagagcacaccagagacugaaugaaugggugacgaagaaaauucugauauuaaaacaaaacaaaacaaaacaaaccagaaaaaucaaaacacuguugccaggauacagaaagagacagaaacaaaguuuucucaacagaucgguagcauuaaaaaaaaaaguguuauaaggcucauaaggaugggaaaaggcagaaaguaaaaucuaggacggaagucaacacacaugggaauuauuuucaaaacccgaaagcgaggaaagacccacagauccucugagaaccaggggaggucacuugaaggauggcgguggccaauccgucuucgauuucacaaaagcagaacucaguugcuugaauuuaaauuacaguuauacaguucuggacaagagcauccuauucaugagugugcaggaacccugggaaaagggacccuggaagcccauucuucuccacagguucuuucagaucguucaaaggggcucugcgccagcggccccgggaggauuaagcaaggugccagagcgcagcacugccagcuccgccucacucaguccccuuuuacaugggccauugugcagacucggaguuaggugggaauccagggggaauaucuauacuuucaaguucaaacuaagucacucucugaaaggaaaagcuaaacuaggcuucccugauccuucaauaugaaaacugaaaaacaaaaauucaugaaacgagcaaucguguaaguaagcccuuuucuuugcugugcacaagaaucugaguggcagcuguggagggcauuacuacaugccaaguccuguauuuuaaaaaguaaaaauauugaacugguuuaauuaaaauaaaaaggcuuuaagugauucuccuccuccccccccccccccccccggccucucuuagauguaagaacuuucuggcuagcucuacuauuaaagaaauguacuuaaggauggugauggcagacugucuaucaguucauuccuauuguuuucauuaauggaaaaaagcaggcaucucuuccaggguucaauguccuucugauucgaaucagcuucuuuggggucaagugacaagauggccagauauaaagacagccacuucuagaaguuaccccgcacccuggaagaucaacuucaagguuuaguuccaguuaagaauaucauuggccagagggcagacagaaauaagaaaaaugcaccgcuauagaaagaugaagggcgagaaaucggagggugacaggaauggaccccgaaguggugaguuaguugaaggaaggcagcuuugugagaagagaggccauaacacuugacuacacaucauggaaaugacaaggccuuccucaugaccauccuggcgacucacagacuucugguggauucucaagagaacccuuuuaguacagcgguccaccguggcagcccacuuccucuuugccuccucauccuccuccagcaagcaccgccucagguccugcuucuccaccuugcucagcguccuguccgaggcaggacgcacgagcugggucagguucagguggcuguagaggcuccgcuccaccacguaggugauauugaacucgcugacugaggugcgcccucggccccuccugccagcgaagccgcagccacugccacccuugggcuugggccguggcagcaggucacaggugcugccauuuacuccuuuucuggagggacgcuggcagagaaaaguucuggaacaggaguaauuaguauccguuuucuucaagcggauuugcuuacggauacucugaaccuccuccaaggacaccagaaaguggugccugcgccgaugguugucauagaagaaaacaccaucgguacuuaccccgugacucaaagacccaagaccuuucuucauuucccccucugugagggagcgggacacuuucugggccuucucuucuucuggauaggagaagaauguccccaucuucuuagggggcuuaaucaggccccgacucucuccuuugcugaagguuuugaccaacuuccggccagcuccccacguauccaggcugcuggaugauggagauggggugagagagucugcaucaucuucuggagguuucucaggagagccaucauagaaaaauggcuuuuugugcacuccagaguagagugcagaucuuucaucuuggacuggggaauucucaaauacauguuccucuccaccuggaagggaaccaacacgaggucuccugugagugacugucccauacaccuuugucuauaucuguaaaacacgucaucacucucauggucaaugguaauguucucccuguuugcccuaugaucugaacuucuucauaaacaugacuugcaggucaaugcacacgaaacaaugaagguaaucaaacuacauuguauuguuucaagaaagcuuaacauuacacauuugugaggugccgggccugacagaggauggauggcaaguucaaggucaaccuggcuaacuuaaugagauucaaaauaaaagcuuagugguuuuacuguucauggcguugaacccagcuugggaggugaagguggagaugaagaguccaaugucauccccugcuaaauacagucacggccagccuaagcuaccugagacgcugacacuaaaaaccaaaccaaaccaaaaagccagauggaggcauagcugaaaggcaggaaggacguauccagcuuuuagcaugugugcaguuuuacauccaaaccuaguacuacgaaacuagagcugagaaacuuguggugucuuuuauuuuccuccaaaacaaguuuguagaccaacaucucccuugaccuauuaaaaaaugccacuugcagaaaucaaggcccaucauuaugauguacguuagcacugcacaauugccaccgugguaugugggugcagcacucagaagcuaggaacagucuucccuguccugaaagacccuccuuuaugucagcucugguggcuuuuauaguuggagugugaugagugccauaugucagacaaugauuuuuuuuuuuuauugguacauaugccauuuaagugauuaaaucuccgagaguuuggguggggaaaacacuauaaaggguuauacuugcaaaugugauugacaaauggucuccaguugccuggccaaauacaaaaggccagaggaacugagugacugcagccagauagucccauccacccagccccggaggaaacagcaagggcauuuaagggccuugacacgcaggcagcucacuaagugcuccacuugggcuccggcuuccaggccuugacgcucucgcuggggccagguaucgagccaaggccucuggagcccaguggaaaggccuggaugugcuggcaggagagccaaguucuuuucugcauguguuaugugaacagaugugagggaggaauuaggucaagcuguggguguagagcccaacuggcugcaucccuuaauuauaaggaaacacuggagccuugaagaucuccaccagcugagcaggggcguagggaaaaauacagagcucccugggacagaaggucagcacuguacauaagcugggacaaagguagcaauggaugguuaaguaucagggagaaagggagaggggaaggugauaaaauggcucccauuucuagaauauucuaaaaauggcuaccuuuucuaauugauggcuauuaguuaagaaagaauuguagcaugaaauccuacuuaagaccaacuccacauucaugugcagaaaugaguggugaggaaggaaggaagaaggagaaaucaaaaugacaccaagucccaaguucacagaagaauugucugaguaucuuuugggacaguuuaaagcaagguccaggguuggacaggauuuagccagaccacggacaguacucaaaugugagggcuccuuccugcuuucuccuccagguuccuaacaaauauggagacugacagugcuguuucccaaguaaagauuauucccugcuuccagaaggaagcaacuggauuaagacuggaggcccagcauaguggcagagguaccccagcagugaaugaauacagcuauguuaaguuccucagguggaauagauuuaugaaaagucuaagcaacacaaucccgaaaggcuccauggaugcugguggccuuugcccaccucucuaaguagcugucacucaucagugguccaaacaucuucuggaguguuuuggggacagccgucaggcgcuagcugggacacacauguuccugacaugugcagccuuacccuggaaaggaacuuugaggggaauaggaaaugccuccaaaggggcugugucagccuuugugagcuggccccaugcagugugagcuucacaguccaugucugagaggcagcccagaagcccagccccaaccugggcuccaucaacacaguacucuucuccugcccucuucugaucaaaaggaacagcuucacucugcagguguggugagccaggggagccccaccccacccccaaucccuguacacuauguaaccugcuucacaagggccuuuuugucuaagcugagaucacaauacccaaggagaagugaggacaugagaccacuucacccgaggauacagcuuuguacaaauucuguucuucagccauagcuccaggaccuugggcgucugguuccggcuccgagccgugucugucacaacaccuacugaucuuuagcuaaugccccauacaguuacaguggguguuaaguuaauaaaaaagagacaguugaagcuucuucuugugcuaaaaggcaccacauagaagcugaugauccuguacuggcuuagaagugcuggugcacugcagagaugcggccggacacacagaagugggcagaugacagacaaagacauugcccacguuuaauaucaucuagggcugucaugucaggcuauacuuggaaagucaacacaggagaggaagaccagauaaagaauucuaaagccaucagaucuccugagugguaggcuguccagagcaagcaggacacccuugaggaagucuggcugagggaccuugaggaacuucccuggcuucuucaucucugucucccuccuggugcaaugagugagugccugccacugguggguauuccagagacggcauaguaaaaggggucaucaguucucaagugugggggagaaacucggagcgugcagaacgcaucuccauaaagcagcaugauuugccguacaaguggugcgugcaggcaaucagugacuugaucaaaucucuguaagcccaagggcacuggggaagaaggcaaacaucucacaacccaaggagccugucccaccugccugcucuuccuccaguuggagcuuggucacgugggggcuggaggcagacacucugagcuacacacacucacacacacucacacucacacacacacacacacgcacacacacaugcacacccaggcaagcaugugcuuccaugcacacacucacaugcacacagagugaaugguucuccccagcuuccuagcucaucauacuuuagaguaagccuugcaauuugaguucaagcccaacugugaggcccgguucccacucagaugaacucacuuggaagcccaccaggaaguuaucuuaggugacugcuuuuaaccuucaagugccucuucugguguuuucccauuacccagccccucaacauagcuugaauuaauauacucugcaaauuuggauauaucaagauguaugcauaaaggcuaccacaggacaaguccugccagcucaguacugugacacucauuuaaugucacuggugggcaagcccguuguucugauugucacagcugacacuggauuuugguuugcuccccaacacauacucaggguugggcacuggcgauucuguguaguucucaacaaaaguacaaccucccuccccaugcucacguuuugguaagaccugccguugcguggguucuguacaguagaaaugcuggccagcagaaagugacagucaacuguaaacagaauuacuagaccaagggacgcucaaaugcagcucccacauuaaagggaggcccacauuuaugaaguuacccaucaagcuuaucucucuagccaaccccccuuuucuucuucccauccuccauucuuuuauagcuaccagcaucuucagcuuugucauaaagaauuaaaucgcuguacagcaacaaacugaauuaauuagaaagcaucaauaauggcaagaaacccuuaucuuuaaaaauaaaaggaaguuuugguuuuauucacaaggaucaaaaaggccuuuauaauaauaauucuaaaaacccauguguuaaaaauuuugaaauuccuuauaacacagacauaauauuuuuuaacaagcagugcuuuccuuauuaaaguuguccaguauuuuuccuacauacccacuaucauuuuauaaacaagagaaucauacagcugggugggguugagacagagugucuaucaaucuuacugcuaugcgaaguggcgacugagugucacuuuagugucacuauguagcacacagugccccccucucaagcucaggauuacugggauuauaaaccucguaggugucggccaccacacuccagaauuuuaaguuuuuauuugaucuuuuugggggguagaauuuuauauugcuuauacaucuuauaaauaaaaaaugaguaaggucacaaauuaaaccuucauaauuauaauucaaagguuacuauuuguucuauaauccccaguuaauaccucuggcugcuucacuuucccaggcagcucuuagggauccccuuagaacugaagguccugaaagccccccuuuugaauagagaauugagauuguuugcgggaagaaccaagcagacccggggcuuugaagggauauuaagugccuugacugucagguggcucugcaagauugaugcacugugaaucagaccugcaccagauccacugcaucgcagacaccaguccucuucggaagagaggcuuaugcugagaacuugugggguuuauguauagcaacacaagcucauaauuaaagcagugccccaccuucagacuuuauccucagauccgagccauuucccagcucugucacauuugaauuacugagugcccaaaauacuugacaccaggauccuucauuccauaacacucuaagcaucacccucuggcacacagacaacuguuggccuccgccagaacucaauucauuuccuacuugaaaaucauauucuguuucuacugaauaucugacccuaagugguuucuuuccgaagaaccagggagaaguuugcccccaccccaccccacaccuuuuuuuuuucuuuuuuuuaccuucugugcugggcuuuuucauuucuuccacccuaauuaguuucuuucugacucuucgaguagaguuuaccagcuugugcaaccucuuaaacuucaccgaguccucugucucaucauccgacugcucucuugacuggcaaagaaacagaacaguuaaucaguuaauugcuccagagccgugcccucccagcuggcauagcuggccucucagccaaggccaaacauccgcagccccaccgccaaacuugggacaucaacgugggacaucagcaaaucuaccccccaagguuuauagaagccacacauacucugggauggccuaauauagcugagaaccaaacccaggggcaaaguacacaucuuuggcccugacuacuguggggguguccgccccauuugcccacucccccaguccagcagagcuuucuccccaagcugccccuguaauuccaguuacacugcugugguuuggaccagccucuccugucuggcccacugggacucgcuugagcauggucaucaaccacuucuccaaaccaaaaauuuuguugacuuuuuccagugcccccucccccaccaaaaaaaaaaaucaaaaccagcaagcagaaagggggaagcaaugacaacaaaaaccgaaaaaccuuuccuauuuguuggaaaggcccgccacaucccagccaccccuuccaccuccccuagcuccuucugagggcucucagggcccucacauuucuccaaaauggacagccccacauuucuccaaagagacaagggaaaaagcugaccuuuacagccaugcaguacgguccauauuccccagcaucccauuccauuuugcggcgauucaaaugugcucuggcccagcuguuuucccucaaguaucaaacauuacagaggggaggggaggggaaucucucuccauagcagugacccaggcuaaaaacaauccuuuccuugugaacagagcgagggcuucguuuccaaguccaguccaacauucaguaugcagcuuccucugcucaaaccgugaaaacgcaaaagacguucccacuguagcagcgcuucgcaggcugcagcgcccgcccggggagcucggaccuuuugggaguacccgagccucagcacacccggcccagcuaauccugcacauccugacaacagcauccccucuugcccucagcgcaauucgcaauucgcaagcaauucgcagggagggagaugacucaaccaccccuucccaacaagacaaaaacaaacagcaucucgauuuggugaccaaugggggcacuuucccccaagaaaagcccucccuaaucucaauuuuauaggcaaucaaauaggcaaaugagagaaaggcacaaaaggagagggguugggaccauauggaugacuuagaaaugguacaagcuggugcuuucccagugcaaggcaguacucucuuguggauaaacuugguccguuuucccuggagaucacagcauagagccagugugcuuccuuccagugugcaaacaauuuacccacugaugacggaucaguaaaccaucagacuggaauagucuuuagucuuccugucugugaaguaagucaguaucuauguccagcaucucuaaaauuccuaggaaacuacugcuugcagauucacaauuaaagcugccuacuguucaaaugcagagauggcucagggauuaaauagcacuggcugcucuucccgaggacccggguucaauucccagcucccauauggaguucacaacuguguauaaguccaguuccaugggaucuggcauccuuauacacacauacaggcagcuaacacuaaugcacauaaaauaaaauaaaaauuaaaaauguugccuauugucuacuugacaaacuagaaggaaauaagaaccacccccuccccccaucucaguaagggaaacgggcaguuguguugaacaauuaguauuaguauuagugcacuaagcugaaaggugcaagauuuaaaaaaaaaacaaaaaacaacaacaaaaaaaaggaagacguuuagcugcuccaaauacaaaaugauaccaucugguuuaaauuucauuuuuacuuuguugcauugcugauguguacggaaauaaaauggucagcgcggccaacuaaaggcaggagaacacgguuacccucauucugggucauaagugccugaauaaaucaccgugcauugaauucgcgcaaacgcuucaaaaugcugugucuucccacugcaguucgggcauccgcaauucaaacugaagaacuaaccuuacacugcacaaggucucuguguaucacuccuacccccugaaaacaaacccaggcuaaggaucuaaccuugacacuguaaguuccagagucaagucaaaguugaaauaagcaucaauuguaugcacuuaggaagcuagcucaaacucugacaugucaauaugcuccacagcgaguuuguugguaguggcugcuaaugacuuguguuauuggggaaagggugcggacaagagcauacaaagaacagaacagaauagaauagagaaucgcuaacacaaaaaucuucuacagagccacagagaaggcauagaggcagaaaaggugcaguuuugugagcuuuccaggaaggaacguaaguggucacaucaggucaugagacuggaagccaacauccguucccucauagaagcuuccuucccucggcccggguccccuugcugguuucacagggucugcccacuuuuugaggaacaggagcuugagaacuuuacacugguggugcuuguauccuucuaacucaguagagguucuggcagugucggccacugacaaaccacaagccguagcaacuaaggacuuccucugcaguaucacgcuuuggacccuaggcaggcagcaagccacugaagaaaugcaugcuuguguggcuuaucuucuuaauuagaagucagucugggagguauuugagcucuacagugagucuuugagacacuuuuuauggauggggagggucaacuucuggauuccuuuugagugccagagaaaagaccugugacauauuugccuuuuucaaaaaauaauguuuucuuaaagauuuauuuacuuuguguaugugaguacacuaucacugucuucagacacaccagaagagggcaucgggucccauuacagaugguugugagccaccaugugguugcugggaauugaacucaggaccucugguuagugcucuuaaccgcugagccaucucuccagccugacauauuugccuuuaagaaauucucuccagcuguuuucagauaaagacacaaaugacugcauuucuucuaaacugaguaauaaauucuucacuguguauuucucacuaaaauaaauauguguuauuuucuaaaugcugaaaguagcauagcaugauauauguauauauaauauguaauauuauauauaugccacaucuuuuauucaaauugacuaucauaaaagggaguuugagaaucccuuaaauuaagaaucauuaaaaauauguguauauaauuuuaaauuuuaaauauuuuugagauagcauugauaaacagaaaauaaauauuauauaaguauauauuuuuagccuucuuacuuaacaggggucuguagaauauaaaggauuucuacuuuauauauaaaggauucuaagaaaaaggcucauaaccaacacagauucacauaaaacaaaacaaaagcauagaaacauaugcucacacauauucaaacuucuccaucuugguaccccugcaccucuaagucagaguuuauuacauuuuacucaaguaaacuuaaguuugaucaucuuauaaauaagaaggugacuccaucagcuuuaucugcccccauucuaaaccauccagagaaaaaaagaugacccccaccacaagacgugcaaauaccucugcaguguuguaaacagaaacauuucacuucaagcuuuccgcugcagauuucuuucuaccagaaaacccauauggcucaaguuuuaauuacuuuggcuaaugcuauauguaguaauucuguggugaaugcuuaaguguuucauuucugguuuccauagcaacauuacaucagcuugcagacagcuggcuccacaguuuuaaaccauaacaaauugaccaagccaaggcacaaaacuauagcugcuuuaaagagauagcaaguccuucggcugcuaggcacugacugaagagucuauggggccauuuggcacggacaggaggguggagccuccuuucuucccagcuucucuuggaacaagugcauccuuugacacaucugugauguucuaaugggaaaagccauggagccagcguggagaacuuuuuauaacacaacuacacgcaauaugaucaggggaaaggaacaaaauuaaucacaucuguaaauaagauuugugugcuggcguacacggcuuauccuaagccugucauugcuguccaaacagauccuucacugguccuuauaacaaacaguucugggaugugcagaauaaaugguuucuaaaaguuuaguggcacaguagcaagggaugugacgaauaaaugguagucugcauuuucaaggaacaauuagauccuuggggggggggggggcgcacaugagaccaucuugagcacagaguuauaguugccucccuagcuccaaauccgagacacacugucacagcgaacaaucagaacaaccagacucagucauuuguuuguuuguuuguuuguuuuuguuuuucgagacaggguuucucuguauagcccuggcuguccuggaacucacuuuguagaccaggcuggccucgaacucagaaauccgccugccucugccucccaagugcugggauuaaaggugugcgccaccaccacccagccagacucagucaccuuauucccccuccauccagugagacaacaucauacaauauuuaagccuuucugagaaguauuucucaauugcaaauauauuuccuugggaaagaucaugcaacaguuuuguuugaacuuaguccauaaaaagacacagacacacacacacacacaccucaacuucuacggccacgcugucauuacauuaauuguaaauguaaugagaagaaaggcagucgguuguagauuuauuuaaagcaaugccggaugcugucuagcucuaagucccucgcacagagucagcacagcccacggagcagcuccagcucacacuuacucauucuuucauagucucaaaaucaugguuaguauucuccaaaaguuacauacggcagcugggugacaacgcucagggguggaaggcagguuaguagcuagaaggagaaaugcagcucuagaaaaaucgaagaagccaagaaaguugcuuccuaagcagaagugaacagaaagccuuuuucuuggagcaacagaaaaguuuugcuugcacacaaaaacaaacaaacaaacaaaaaaacauucaucaacuuaccggcuucggcauuuagcaggcguaagggguaguuuuuugccccuucccccuccccacgcagagcaaaccccacucuugauccgucagcccugaaaucuccgagucggaccaggcacucccacgagcauguucuccguaguuacaugaucgggcaggcucucccagucacagcccaacaucugacgaagagcaccaggacacugacuggauucaauuagccucucucugccugcugccugauccccuggccgcuugcuaacuguauaacuuguaagaaaggccuaagucaucagcucuaagcaaaucuccuauucaccacaaggaaaaagggaguguugugcauggccaacaaucccuguuuucacugaggaaggcucccugaccuccugcuggccucaguuccuuaauuacugucuauggaauuccagagaaagaaagaaagaacgcgagaaucugagcgaauccgggacagagggcuaacccuuccgagugacugaacucuaaaacagaucgcuucugcagaugggcuuccgaacgcucccugaggggcguggucaccauugaaaguggacaccuuuccagggcuauuuuugaaauuacuaucauggagcuugugauucugguuuuucucccugacuuaucauuuucucccucuccccaucccccccccacccccuuucuguuuuaauagccagaguaaauguaggcgauuuccccuuuccuggggcuucuaaaacugucuucccaaauuguuccgaccgucauuucagggcagcugaguucucgggcauucuggaacagcaagccuggggacuaugucacaugauuguuuaaucuuggggagucccaggggagcaccaggcacaugcuguuacugaaacaggacauaggcuaaacaagacagagcugaaaaauggaagaaagaagucuccaugacgugucccuucccguggcucaccucacugaguuaacccaccgugcgguuugcccuaaucacagcgcgcugccucuuccaccgugagggccuuccuuauccaucucuuuagaggcggauacagauacacaacacacauaaaacaccuggcagccagagcucaccgugagugccaaucucugucuccuuaaaauagcagaaggacuuuugggaggaggucuagggcuuacuuaaacggggguaacauuugagacccaaagcucacaaaaggaagguccugcuuugcccagagucuccaguuuaguuggcagccuggcagccggucuuccccauuuucugggucccucaccugcuccucuucccucccuucccuccccuuuccuuucccuagaaagcauugacuccaugccccuccccuccaagucugcugucccagaagccucucuucuacuuuuaacugaaacuuucucuuuuuccugccacaaggauucgccauagcuuccccuguacugccuggcuccccagaucacaaaccaauucucccaaagccuguggcuucaccgcccgccacuggcauuucagggccacggaccacacaaaugguggcaggugaguucuggaugaaguacgaccagcucugacauucagcaagcaucaagccugcaauccaugaaauggguucagacaugaccccuuucucaaacaggaagggcaagguagaaaguggggcccuguggcucuguccuguggcucuguccuguggcucuguccugcgguucugacccuguggcucuguccugcgguucuguccugcgguucuguccugcgguucuguccuguggcucuguccugugauucuguccugcgguucuguccugcggcucuguccugcggcucuguccugcgguucuguccugcgguucuguccugcgguucuguccugugguucuguccugcgguucugacccuguggcucuguccugcgguucuguccugcgguucuguccuguggcucuguccugcgguucuguccugcgguucuguccugugguucuguccuguggcucuguccugcgguucuguccugcgguucuguccugcgguucugacccuguggcucuguccugcgguucuguccugcgguucuguccuguggcucuguccugcgguucuguccugcgguucuguccugugguucuguccuguggcucuguccugcgguucuguccugugguucuguccugcgguucuguccugcgguucugacccuguggcucuguccugcgguucuguccugcgguucuguccugcgguucugacccuguggcucuguccugcgguucuguccugcgguucuguccugugguucuguccugcgguucuguccuguggaauaagcugguuuucauuucaaaguaacucuuagcugaucaucuuaccugaucaucuuagcugaugaugguccuagaauuccuaaacgucacuuugguuugaugacaucuuauagugcggaugguguuccuagagcucagcagugucuguuaccuaugcgucuucuauuggguacugacuggaggcacaagaagguccauaaagcuggaggcacaaugacauucgggccucggugacacuggaugcuaaggugcagagaaggcugggggagcuuaggagaugggacucugcuauuccaaagccauggagggguucagaucuccauccuccacugggaggagcagcuaagccucaggcacgcguguuacugucucucauuucuagaacuggcugugggaucuagggaggagagauggugaucccuuuauaugaagccuggugccuggcggagugagaagcacggaagcuuggacugauggagacacagugaagaggcuagagggaagagauaucgcucggcuccccuccccuacaccagcccagccaugaccagcuccugggggccaucuaugaggaugaacaaaagaacugaguuuaaccaucccuucauacgccucugcccccaccucucaguggacaagccuggcauuuauagaacuaaugugggguuccaugccggacacaacauggaucugaaacuccguggggacaaaggccugguauagucuccuggccuggauauaccgagccugcucauagaaagccauucccagagugucugccuacggcaaucccgcuagaaacguagucaacgaggagugaagaugcucagaguucccagccacacaacacagcugccagccuucaccucgcaucagagcaaaagcucaaccaacagacugggcuaacucgaccuaagaaaaugcuugguucuggaaaaacaccuccuacagucuugcuuuuuuaacaguggacuugaaccuagcuaagcacagcaggugugcgaaugggcucacagucacauuuggaaugccugaagucgaugcuaaggaacuaucggauaagucucaggacagggugcacacaaagccuugccuuggaacauggagcugcguggucacaccccuucccuuccucacaguuaggacugugcucugcuccacugcucagacgcucucuagaaagggccucccagaggggcugcuucucacacucucccucucagagaaacucaagugccccagguucuugggugcucacacaucaccgaguuugccagacacucaucuaacaacgccucuguccaccaaucagggguugggggaccuucuagccaccccuuucacugucuuagcuuauauggcugcacagcaccuagacaagcuuuauccagugcagcagcucucagccuguggguugugacccucccgccagaggucacauaucagaucuccugaguaccagauauuuacauuacgauuccuaacaguagcaaaaauacgguuuugaaguagcaaugcaauacuuuuaugguuggggucaccccaacaugaggaacugcauugaagagucacagcauuaggaaggcugagaaccauugauuuagagacuuggcauacccaccuuuaucacuguaucgucuggucccucgcugaacguggcaaggagcacggucacggucacuuacagagcuauacuugaguaacacuuucuaucuauuucacauggcaauuaaaacuuugcaaaaugcaaaaccacacaggaggaaaugacccguauccugauauugagaaaaauugguagcguuuugacuuacagcucucaaaucccccgcccugccacauacacacaaugauauaucaucccagugacacaaaggguacuaaaaaccauuccugacccuggcuuuacuuuguugaaguaaaagcuuuccuucccucuggcgccucuugugguuuucuuuagaacaacaguucucaaccuguggguugccauccacuuuggggaucaaaugguccauuaugauucauaacgguagcaaaauuacaguuaugaacuagcaagaaaaauaauuuuaugguugggggucaccacaaugugaggaacuguguuaaauaaagggccucaacauuuggaagguugagaauuacuguuuuagauacuucuuaagucaugcauacuucuuaaauuuuaaaagaagaauacauggaaauuuuuuccaugucaacaaauacucuuccaauaggguacaccaacauuuuagugauuuaacagcauucugucacagaaguauguugucauuuacuuaagcaaugugcgugucacuggacaguugaaugucuccaaccaauucagaugcauacugugacaaaauuuauuaauaugucuagcacagucuuuuucucugaacagaugauuaaauuuuagaauugaaggguuuuuuaaaaugugcacaucugcaaggcuuuugacaccaauugcaacuugcucugaagaaauguguugucuuaacuauauuccccaucauuaccagugccacaauuuuuuuuuucuacuuggauaaauaaaacuucuaucuaucuugaugcuacauagguauuuauugacuggaaugagugaaugaaugaaugaaugaaugaaugagggaaugagugaacacacugauugaaggcacucagaaaaacaugaaguaucaacaugacuaggaagcauccucuaaacuuacaaagucacaggacagaaagcacagugaggaaaagcucgugggaggcccugaagcaugaugguuaaaacaggucagguaugauggccucagccugggauggagaaaagaucugcacaugggaccucgcaccuuagcuauggaaacugaaauguguauuaguggcugguuaacacuaguuauggguuucagggcacauccauguccauacaugaucuagagguuagucuugugauggucccaaagccauaauuccuuguccacucugaccucagaugcuugccuaucuaguuggauaaagcagaguucagcugaugucacuguaucaacagcaugugacaccaaucaacggcagcuucuguccccccuucucugagcuggauuucaucaucucuccaccauauccggucuccuuccaugguccagcagugauguauucaggaucccucccuaccuuagggcuacauucuggcucugccuggauacacucaaaauuuucccaacacuugaggacugagccauguccggucauggcagggaccuuugggucacuguuaucaugguaaucuuuauguuuacaaagagaaaaauauuagucucgcugaguucguagcaauccuguucaacuuaaaucuuacagcuacauaagacaugaagcauacugugccugacauccuacucuauuacaaagaagucaggcaaggagacccaucuguuuaguaagaaauauuuuacucauuagagagugacaucauugcccucugaaauuaggagaauuuugucagcagaugggggaaaaauaagauuccauucuccucccaaagguacugggccacacugaaauaaucacuuuggcagcuuccaaauuaucuaguugucgccaaacuugaggaaaggggaagaggaggaggagaaggagaaagaggaggaggaagcaauggaagaagagaagauaauuauaggagacuuuuauuuggaaaaaguauaugggaauuugaaguaacauuacuauccccuggagaaaaaggacugucagcacuuaauucauuuuaaaaacuuuaaaaauuaauaggcggcccaauggaacgcaaguaugugucaccuucuacaguguacuugcucuauucuguuuccuaaacucaagaacauggaauugcuuuuaaccacccucaaaacaaugugcuaucuucuuuuucccaaaggaggaggggaaaaaaaaaaaaacagaucccaacaguccuaccaccaaaccuagggcgacucugagcccaagaagccaacccacuccaaagcuacaagcucccuggaagcagagaaaauguuuuuccuucuuccccugggggugggaaggauggaggaaggcgacugacuuccccuccauagguaaagccuugggugacuuuucugcauguugucaucccauucaggggucagggggaccggcuguugauaugaaguagcugauggucacagugaaaggaccaagaaugacuagggagccagcagcaauaggagaccucccuugugagagccugggaggugcacccaacgcacgucaaugacgugagacacccugcagauucuagcaaacucucccgaccccuggccccgcacauccccaagagccccaggcucucaagcagccccaugccaauggagacggcugacucagaacagcacugccaaguggggcaaucacacaugaacuggaaaguccaguguucauucccgaagucucuaagucuccucagagacuggguguguugcaaagucacauugcuuuggcaucucaggcuacugacucaugguucaggcacagugacuucucaggacagggcugucuaacaacuuagucuaggcacacgacaaugcagaaauacagagagcccaaggaaucuaguaagcacagaaggaggcuauagagacccaccuaugccaccaggcccgcaggugagcccaugccauuccuaaagucacaaucuguauaucuauuugguuuugucuauagaauuaauaagaagaugcaaguucuaagcuaaaggauccaggcugaaugccuaucuuuaaaaagauagauagauagauagauagauagauagauagauagauagauagauagauagauaauuagcucugaggagguuguuuaucaucagugaauuagcaaaaccaucaggauacgauugcugaacacugaaccacuggauggccuucucagagagaucagaaaaaugaucagccuccucugccaaaaaaguguuagagcccagcaaaauacacuuccccaucaacaaguaaagaaaggcucgugcauuaacacuuagaaacugcauggccaaggcaagagacgaaucaucaaaguucccucccacuuaaaaacaaaccagacgagcaaacagcagagacuucuggauucugaaaagaaacuguuccugccucuauuuuucaugacucaggaacaguggauauggaacugggaaucggugagugacagcugaucagcugaucacagagcugccuaaucaauauuaagccucuggaacucacuagaaugguagacuugaauaaagacaggguggcucugcuggcaugaaccaacgggugugaguugugacagagcugggguggggaggaguccaguaccaggaugccucuggagaccacauucugucacuuauggggcuguccagucggagacagcauuggccacacaacuggacuacacaagagagaccucagcugaaucuuggaagaacugggacggggcagggagagcuacuguuacacaaacguaacacuccugacaucagcuccaguacaaaaugugacuagagucaccccagugcgaucagguugggaaaacauguaugauggcuaauuaaaauccaagaugugacaaguagagggggggaaaguggguagcaaaagggaacacacgaacuuuggaaaaauggaagcaaguuuuugaucuuauaucuucacuagggaaaaaauauacaugcaugcgugcacgcgcgcacacacacacacacacacacacacacacacacaugagccauauggaaauugcaguugcuucacugugugaacuaguuuaaggggcuggaguaaaugcacuuacuucuccugaagagaacucagguuuaguucccagcacccacgcagcagcuugcaacugucuguacuucuaauuucaugggcucugaggcccucugcuggccucccuggguaccaggcacacacagggcacagacuuucgcgcagacaagcacuugaacacauacauuuaaaaaaauuuuuuuuaaauaauguaagucaugaauuuaauuaaaugaaaccucaaagauggcacacacagaugauacaacuuuaaagaaacagacauaaauaaauaaauaaauaaaaagccaaaaccagguacagagucaacuuguuaggaagaggggaccaagaacaccguguaccuccagaagucaaaauacaaagagcuccaugccauguaagucauuuuucucccacuaugccugauugaaaauauccagcucuucaccuugaacccugccaccccgcuuaccugacacccacuucucuuuuuucaccuggagaaccaucugguaucaggcaccauccuugggaaagccucugagggcggggaaggggguggcaggaggggagggggcagagggaggggauggacuuccauugugccuggcaccucuccaucugucugauggaucaucccaaccacaaacucacugggaauaaagaacugguccauggcacagccucgauaaauguuugcccaaugggugauuagaggaaugcccaagauggcauuacuucaucuacacacuggaucaaaugggcaacagggcaggagaugaaucacguaguuuucggaaccaauuaugcaaugcucuuugcuuuauacaacuaacaguacaccaucaggaccaccggagggcguggugugacgcagagaagggaaaguggggcucagaagaggacagaggaauauuuucaguggcuauuauucuguacaacuaggauuuggcuguacuaaauaccgcuuucccauucaaaacccuggguucaaccuccaggacccacaugguuuuauuuauuuauuuuugcuuuccaaaugagugucauugucugcugcugacuguaguucugagaguuuugguauaauggguaauuaugaugacagaguucaaacacaccauaaacaagcgaugggcggccugugccuucaaugaacuggcucugcacccagcuucuuagauccugacucugaauucuguucaugaaccacaagaaggccuuguggcccaauaaacaaggcuuggcacuggggcaaaugacuuaaugaagggcagagaugugacgaaucaauaacacaggacaaugaaggacauccucuuuaucuucaaacucccugaagucucucccuccagcggagagaggaagggcuacugcaaauccaaaugccaaacccugacccauauucgauuuuaucugcacuuggauauaaccagcuaguggaauuaaugugguauaucucaacugguagcuguacauuaggcuggacaaaugaagcuucauuuguauaggucaaaagcuaucuuuaucucuaauguuauagauuuauuucaaccugauaaaaaagaaacaaaagaccaaaguguauuaaaaggcuaucuuaaguuuaaaaagaucucuuuagaaauagacaccaucagaauaugucauacuugggcacucugucaguauuuguuuguauucacguggcccuugauacacugaggcggguccccacaaacaauuggaaacaaaggugucccugguucauuugcagagaacccaacuugcaguuaugauuccugggccucggaugaggauucccuccacuucugagagagccagaccauauacuaaauccacccgccuggaagaccauccccacguagauaccugcuuccuccuuucuuacacguggggcugcacucacaccuagccugaauccauuuacaggcagucagcugcaugugcauuugagaagagcagaguagaguccgagagcauuggugaguuuucccaacugggcuacugacauguacacacagaggcauggacauaaauagcacuugugaggacucaaacauuucaaugauggcaguggacagaaaggacgggugaucuucccacagaguaacuaaaggugacgacacccaucaggauugauugcucugugccguuaacacucacggggcacacuggguuggcugaucuagggaagaaacugaaggacaaagauggcugcucugccccagaggcagagcugacaggguaguggaauccagaccucacgccugacucaugucuccgcuucuccagcccuguuccuacccacacugggugaaugcuggcuuccaggucugcagaggcuaguaccuccuucuugucuaacuugauuucuucauggugaucuuaagggacucgugaaacacaugccucagacuuuggcccuggucccagggagaaggcugggaaugggaggggacagugcugagcaaagaccaggaaguggagaaaugaacaacaggaagucaccucagcagaccccaccaccaccuuuaaaccacuugcaauuuggggcaaauucuuaauucucacaaccccucucacuguggggcuaggaagacaggucagccaguaacuauaagucucacacaaaccugaggcucugaguucaauguucauggccuacaaaacaaacaaacaagaacaaaccaggcagagguggcaagcagcaagaugggaggcagagaugggagaaugaccuggaagcgcuguggccagcuagccuggagcuacacaguguagcagcacagauaagagagacauugcucacaagggaaaggucaagaaucaauuuccuaacaugugcauauccaccaagcacuguauacauuuguuuucucucucucucucucucucucucucucucucucucucucucucucucucucacacacacacacacacacacacacacacacacacacacacacacacacauucagagacauuuggaaagggcuaauuaucgagguccaguggaacucauccaggugugcagaacugcuaagcugggaacagugcgcaugguagcguguuugucuagugcguguaaggcccacggcucaauccccagcacuuaaagaacggggggugccuaccugaguugggauauaagugcccucugauaacuauugcugggacgccuuucucuuucuuccuguucaccuuacaagggaacugggcccacucauguuuugcgugugaaauugagaacugaagcauagguccaguuaccucauggucaagugcagcuaggauagcauuaaagcuucaaccuuagagccguuuccuagccacaaggaaaaaaccaucuugcuaauuugaaccuaucugggaugaagcugagguacacaaaaguuccuguagcagaaaguacaaaggcaaacaggggagauuauagaaaacccacacucacucagucgcccgaguuaguuuacuccuggaaucuagccucucguagaugcccuccucuuagagcaaaacaauauaagagaagacaguggaaacaaggccagccguuuucuuggaggaaauggguccuggauuggcagcucuaaugcugucauauuuaugcaucauuuaugugcccaauaaauauucauuaccauccaaauugguaaaaauguaaaaaccauauauuuuucaaccaaggauuauuuacagguggggcauuuugaaaauucacaugcugucaagucuuauuuccccaaaugaugaugccaauuugguucaugauuuucuuugaacauuuuugaauaugaaaauuacauuucugacaaauguuaacuuauagauauuaguucucuaugcuaaaauaagcauauucaauaaacacauuaaaaguagcccaguuagaaguugggcauaagggcacacagcuguuaucaaagauacuugggagcugaggcaggaggauugcuugaucucaggaagucagcauauaccagggcaacauagauccccaucucagaaaagaaaaaauaaacuaauaagaagaggaagaggaggagaaaagauucaaugcagaauggcagacucuagacucuaagaggcucaucguauaugcauaaaugaugggggaaccgaagcgugaagacgcagccuacucaggacaugccaggaguagacuguaucuuuuccauaauaccauuaggccaucugcuacagaacuaguaccaagcaccuguguggugugcucuauagcuuucggcacacucuaccagaauagcuagugaugauguucuagaaaguuguagugcagaccuccccuagagggacagcaaacuugacuucucuggcuugaagacaaugccuguuaauggggcacaugaagugacuuugaaaagccuacauccugggcugccaacauguuacaggacagggugcuuugucuaguacgcgcaaggccgugaguucuauccuuagugcuacauacagaaauaguaacaaaaccuccugagcaaaacccagucacugaaagucuacaguuuauaauuugagaacauuucugacacuuuaacagauucuaccccaaacauaacauacugagggcauauuuuagugcugaccuuccuugaacacuuccgucaacacuuaaaaauagcaucuucagaaaaggccacauaacauuuuguuacucaaacuuuggaaaugguccacccacauggcuccccugaaccucagaccagguuagcagucauauuuauaguuggaaugaaaggcuagaaagagaggguucccggaugugaggaacuauaacgcccucguagugcacgguaauuuucccuuaugaagauaucuuuagacucguacgcuaagccuccucaaaccugaauguguuacaugacagggcgaucugcuucacaaaacaacuggcuucacaaacauacuccacaagaauuucuuuauccucucaaagaagcucggccuuggacacaugauuccaacuuuuucuagaacacuuuacaaggugugaaguuuauccaauacagguuugccacuccaagagguuugcaauaccccaugagcccaucaacuuuaucacuaauuucaguucaagcacuuucacuaauguuaaaacaccagacacaauucaucagcucuuguccauuagcucugcgaaaauauaaaacuauuuacuaagacuuauggcauaauaacuacaagacugugcauaccugcagagaguguguguguguguguguguguguguguguguguguguggugugacugugcauaccugcagaggccagcagagggcaucagaugcccaggagcugaugcuacaggcaguaaccacuaacuggaugucggugcuagaaagugaacuuggagagggcucuuaacggcugagccauuucuccagccccuuaaauguguucuuaaccagaagguaagcugaaccugcagccacaacacugacagcuccucaugacagucccuauaaccuuccaccuggcaggaggcaagcaacaacaacaacaacaacaacaacaaagcacuacaaucaauuaaaaggaaaauaguuaagcaaacauucagcuauuuaaggaggaauaaaguuaaauucuuagccagagccccuucuaaauacuccaucauggacaacagaagcucauuaugagcagaauccagcacagaacagauguuccuuuggcaaggaggaggcuauuuuucacuuccccugguaacuaucuuuagcacuuuaaacucuuaggaacuaggaaugcacacauggauuuacuaugaagcagcucgcaauuaucuaaugucagcuaugagggcagggagccuaugaaaucagugcaaaugacaucccaaggcaugccaggcgucaauacaggcauugaggucuggugacaaaggccuuaugaucacugggccuuucaaggucugggcauucccaacuaugaccagugagcuauuuacaucuccguauagaaaggaaucaauagaaaagggaagucugccuaacuugggauggcggggaaucaucacaguagacauuaucugaguccugagaaggaggcaauugcggaauaaugauggaauaguucagaucugagggaauguugaacucagucucccucaaaacacagggaagccuuaaucaaguucaagcaaacuucaggaaacucuuguugggugcagcucugcgcacgcaccaugacuaagugguuaugggagugcacagaaagucaacuggcaaaauacgcaguaaauaacucacuuuaguaaacucaguccguuagugacuaucccauggucaucauccacaccucaccccacaagcagaagucagucuuuagcguuucgggaagagugugcuauauuugaagggaauguaagaauuccugacacuuuacuggacucugaccuacugcaguuauuugggcgacaugcagaaagagacaguguggugagagguuacuaauagaauuguguaccuggaacucugaauuuauaugugcaaaugaguaugauuuuaacaucuacacuaaacgugugagcucuuucccuacagggccugccucucuuucuuagucaccuuugcuagcacuaggccugcuucaaagcaagccuccauagacaucuuagcauauacuuccuagaugagagaugacuagcuagcugcuuguagacuaagugugugaaguguuacacugaccuuguuucucugaaugaacaagucaaccuugccccugagucugucaccauugaucaggacaguacacagagggcuugacacucaaggacguacuauggacaagccagcuuugucuucucucacaauuugagugaaucacauccuucuuaaaucccuggguuuacucuucaugauucauuuggguucuuuauuauuaguucuuuauuauuagucuuguggauuugggaugagagcgccagggucauauucaaaacuacggacaugguucuucgaugacuccacagucuuaggacgcaaggcuugcuagccugcgacauauuuauuauuauauaugguaccauuuuggucucucagcaagucuggcauggcuuuaaaaugcacaguccuucaguugcaauggaaaucugguguuuguuuugggaauugggaacaagaagggagugaaaaggguuauuuacuucugauauaguaccauucauugcuuagacacaaugcaaaguuaagacuaaccuguaguugcaagagucccaugcaugcuccuagaggagggaggaggauggauacuggguaacacuuugcuuaagugagcuggacacuggucuaggcgcuccccgcagagggaaagaacacagcaugucugccuugcucaaggagcccgagagagguacaauuauuucucauacuuggggauaaaagccgaggguuguuguauuaaaucuggcucaacaaaagcauaaaacaggaagcaauaaaugugcugugggaggcuaagcgagguuuuauagaggaaguuaagaacuggccuucaccgugaagaaugcacacauuuucagcagggggaaguggaggacauguucugggcagaaaaauuguggggguuaaaacugggaaauaugaaaagcccgggcaggguuuguucagcaguggguauggggacugguguggccugaaugaaggguacugugcaugggaguaaaagauaggaucagaaagaugaccaacgccagaucacacagggcccuggaugccagagcaagcauggagucugugcuauacaaaauaaggaagcaucggcuuuuuaugcaacguggcugaaagagagaagaaguuugugucagacagacugccuauguaggcauagacaggaaccuaugagggucauggggaaaaaguggcuuccaacagccaggaaggagaagagcuagcaaacaaaacucuacacagucugagacacgggaacucccuccauucuugcuccauauuguguuugcagauggcacuguacgggaaaagucuagacugcaauuccugcaaccaucaugaaauuccuaguugaaaggguaccauuuuuggucauauucaaacagucugaaccauuuaauggcauucugguggggaaagaagucagaaugucuaucuguggguaaaaugaucuuauucggacaaaaccaucaaaucacacaggggcauggacaugugcacacgaucagaggaaacacacuaaaccagcaaggcuaccaguaaggugacaagcccaacacacugagauaaagcuagacuguauacuuuguaacaaacugagagaauuaaaagaaugauucuagggguuggggauuuagcucagugguagagcgcuugccuagcaagcgcaaggcccuggguucgguccucagcucuggaaaaaaaaaaaaaaaagaaugauucuauuuauaaacacugaaaauaaugaaaccuuauaggaauagacauaaugaaaaaugcaaagcuuucacaccgaaaccugcaacauauuccugacagaaacuaaaaagacauccucagauggggugccauuucaaugagaaucuuaauggcaacuuuuguauaaauagaaaaauccacccuaaaauucauauagaaucucaagggauuucaaauaguuaaaucaaguuuuuaaaaguaaguaaaggggcaggaaaggugacucggggcuuaagagagcuuuugguucuugcagaggaaccagauuccauugcuaacacggagucugguggcucacaacugccuguuaacuccaguuccgagugacgcagcgcccucaucuggccuccaugagcacuacaugcacaugugcauaugcacaaaggcacaaacacauaacuuuauaauauaaauaaucuaaaggagucaacaaaauuggaagagucgcauuuuacaaguucaagccuuacugcaaagccacaguaagcagucagaugccaguaaaaggacagaucguacaagaagcagcccacacaaggauggucacuuaauucucaaaaagaaugccaacaccauuuaacgggaaaaugucagcaaagagaucuuggaaaacuggauauccacaaacagaugaguuuuuaaauuaaugugaauaaaaaaaaauuuuuuaaacccguaagugcuaaaaaaucuacaaaaccacuagcagaagaugggugauaucauugccaccaccuccacauuguuuuggcaaugauggcauggauauaacacccaaaucaugagcaaugggaaaaaaggacgagaacggaauuuugaaauuaagaacaucaguauaaagauuaccaucaacauaauaaaaaagccacccauaggaugggagaaaauaacagagguuuuuguuguuauuguuguuguuacauuuaacaaaacaaaacaaaacaaaauaaaacaggucaugggucacgagugccaagcacucgaauaaaccuuuccccaaagacgcaccaauggccgacaaucccacgaaaagauguucaacuuugauaaucaauuauuagggaaaugcaaagcagaaauacaaaggaaucccauuacacagcuauugucaagaaauuagaaaaaaaaaguguuggugagaaagaauuuggaaccccuguacucugcagacaguaugguuuacaguuacuguagacaacauacagaaguugucagaaaguuaaaugcagaauuauuaguuauucugagucuuuagacauauauuuaacuccauagaacacuaccgaacuccacagaaagcagacaguguagcccgagguaucuuaucaacacuguucacaauacuaaaaggguggcuccgcccuauaaacugugccuaucaacagaugcauggguaaacuaaauaagaaucuacauuagauauuguggugcuaagauccaacagacaacaggacagacaaacacuaacguggagcaauucagcuuuuaagagacacaaaguacagcagugguugccauaagcaauggaugcuuauagaagacauuucugugugggaagacuugaagccucuggaaguggacuaugguccaccacgugaacgcacuuacuuaagccgaacugaacgcuaaaagacaguuaaugugggaaugcugcuugcuauuuacaaacaaaacccaagaaagucagccugaauggcaggauuccaacucagccgagacagcaccagaaggcgaggucuauggaaagagaccuuagaaagguugggccucaggcugacccugauuagcacaauggucaagacacccccaggacguggacucacguugcagguggaggagccauccaaugucggguaggagccaucgggccagucugcgggguccaagguggaugacugacggugcugggccucguauuccuucagcugcagcaagaacacaugagagacugaagcacaauaaagcucauggacuccacagcagaaaucacaaagaacuuccccacgcuggugacggugauccagggcuagccaaagcuaagccuuccagagccacaagcaggguaugaacccuaccuucagguuuuaaaucagagcgacagacacaacagacucgcgguaugcugcuccaaaaggaaccugauuuucuuccuccaacacuaaaacuuguuuuguccguaagccugaaaccaggaacuuucuauagguccacagguauacaucccagagggaguccuuccucucagaggacaguggaagaggcccgcgacauccaaaugucaaagggagaaugccugaaaccaacuuuuagagaugucagggcagggcuagggauguugcucaaauaguagagccuugccuugccugcaggaaucccuggguucaacuccccagcuuugcacaagcugggcauggagggguguggcugucuucccagcacagagccguagaggcaccaggaggcuggccuguuucauucaaggcuauggcccauuugucugucaauuuuaucacauaacuaauaugaaauagcucgcuagggacuuugaacacggggacagaauaacaaagacaagaaacagacagacaaacagaacaccuuccagagcugcugaaaacguaggcuuagaaacucuguguuuaaacgauaggaaaaagcaaaacgaacacagaaaggaaaggaaauguuacagaaaacggagcaaauacgacaaaaccgaguaggggcucuuuccgaaugcugagugcgagccagucuagggagguguguguacagcacagcagggcagcaccaagcucgucagacaccuaggcuguuaccgcugucacaccgccuuguaauuuagucuucagauccaaaugaagacauugaucaaacuguguuccaugaagcaagaaaguuaaagagagaaacagucugagagcgagggaucacugcagugcucuuccacuggaucugugggacgcagaaaagucaccauccaaaacacauguccuugaaugucucuuuucccucugccugggagaggaggaggaagaggagagcacugcuugugggacaggucacugaccaccccaccccaccccaccccccaccccaccccccaccccacccccaucucauccucuccucuaggacaacaggggacacacugaacccuuguuagaagcucgcucccacaaucgagcugaugcaggagagcucucaacacacaucugugcacaaauacagcaccgugacuaccacccuguggcuucagguaagcgcacagcucacauuaaaagcauauggcccgaagcuccugcuguuagugacacuaaucauuuuaaucauacacguaucaccagggacauauacacuguccucaucuuuaugguacgcucauguucugucuacugggcugauccuuccaucuggauauguguugcuuucugaaaugcuauccccgcccugcaugcuuggggcgaaaugccagguuuuuacaagggauccuuauaaaaaugucaguuuugucugggccucuucucuacucuauuccuacacccaaucuuauccccuccuaccaggagucacuaaguaagcuucaucuucaaguaccacuaagaaacaaaucccuaaccgggcaacugugggcugacaagccguuugaucucccagggacuuuauguuugacucacacagacauagcucaggagcaggcgcguguugucagaugaguaaaugugcaauuuaguaauuaggucaugguauggguagcagcuuugguuuuaagaguuacauuuucaagaaaguaaagacugcagugccaugguuaugggcucucaccuugcccagacacuauccagaaaguugaaauucugaguacugagugcagcaauucugaguacagaguacagcuccccgguguuauguacaaacaccccuggaccgucucaaacauggcgcucugaaagagccucuacccagcuuugcuacaugaaacuugcucacuuuucaaaagcauuuaaccuuccuuucuuuguuauuuuucccuuaaaacuaacaauauauguuuucuaugacacaggcccauuguguugacugaguaucccugugagagaauaagcagggcuuagcucuagccaaggcuuggcgugugaguguauucccuguguuagccuaauauuccacccacacaaauguacaaucacccaaauaaaugaaugcuucauaccuuccuaguaugucauggaacuuucuaguccaugaagacccgaacuuaauugccaacagcuacucgugugcuuaaaauuaguacuugcuaacuguaguauuccgaaaccaccaaacagauccucauaaaccuuuaaccuuuucuaacaaacaaaagugacuuccuuaaagcccaaagcacgugucuaccacaaaacuccuagaaaacguuugacaugccauuuucuuggacagaaucauucggcuaauauagaaaucaucuauaagcuaucuuaagcuaucucuugacaucuaaaaaagacagaauugccgggcaguggugguggacgccuuuaaucccagcacuuaggagacagaggcagguggauuucugaguucgaggccagucuggucuacaaagugaguuccaggacagccagggcuauacaaagaaacccugucuugaaaaaaagaauauauguguguguauguauguauguauguauguauguauguauguguguguguguguguguauauauauauauauauguggagagagagagaaagagagagagagagagagagagagagagagagaaugaauuaaaaagacagaaucccgaauggagaguuuugugaacucuauggcugugcaagagaccgggcaaaggccaccaagccagugguagccaggcagcaggcagcucugaaaccucacacucaguugcauaaagcuuggccaccuuaggccaucuucuaacuucuaucuagcugcuaaaaucaggaguucauuuuuccccuccguuuuuuucuccauguuugaagguauuccuuucuuuuccggcugucugugugagacuauccugaggcccuuuuaaauggucuacaaagucuacaaaugguuuccuuacuccaaggaaacaagcaaacgucauccuacauggcccucaugccaaacacagguaccucgagauggccuuguacauccgcauucugaugacagaauuuugcuauucgaacaggggccuccccgacuccccaggaagcaagcaaaccuacuccccacaaggaaaacacauauagguggauucgucuuauaugcacuuucugggaagucugcuggauuuuccuccagugcuggggcauacacaaggaagggaaccagagaggaauacuugggaacuuugauacucagaggcgugcuugugcacacacgcacaugcgcacuguagcuauuagauuccuauccccucggaugcccccacacgcgucuuagccggcacucacagguaaagccugcacucuuacccuggcgagcgcuucuucaauggugaucauuuucuccuugaccaucaucaucagcugaauccgcuccucgucacucaucguaaucucgcuggcuacauagcccacaucuucuccuggggauuaaaaacggacaaacacaaaugaggaaugaagcagcccuccagccuggaagccccucaguuugggugaaggagggacguuucucggguacccuguugaccgugcgugcuauggcuggaucagagggauguagagcuaagcugcuugucugagagccaaagcgcaucucuuugggaagugcuugcaaagaccauccgugaguuaccacagaagcaacccucccaagugacuguugaguuaggaaucucauuaaacacucgacuuggucagacaggcauuacaaggcuuuuuuggguuaguaguuuaccaggugaaauaugaacgaggaggaaggacaucuaucugugugggaacacaggaagucaagccacagaaccaagccugcugagccugauucaacugccuuccucuacuguucucacagaagagacacauaaagcaagccgaaugcuaagcaugucggccucauggagggcaggggcuacagccagcugcaucuggaaauacuacagucacgugggccugcagaccaugacagguagacaccaucuaauucagagcagaagaccaccagaacuagagaggaaaagaaguucccacggaguccuucuaaaaagccuuuucccacacggcagauaacgccauuccucuugagcuccauuggccaguuguaucuuugguuagcaugugggaaagagcuuagugauaguagucuagcacacauaugaacugcugacucucuaucuaucuaucuaccuaccuaccuaccuauccaucuaucaucuaaguauuauuuaucuaccuaucaucuaucuuaccugucugccugccccucccaccugacuucuuaaugucuguaugcauguuucuguguaagugaauggcauauguggacccucacaaagggcagaaaaggggaaucagauuccccuggcgcuggaauuauacccagcuucagcugccugccauaaguacugggacucauacucugguccuuuggaagagcagcaagugcucuuaaccacugagcccucucucuaggcccugcccccucucuucacugccuucuuucuccacagcuuucuaaguaaugcuuugucagaauacaaagucuauuuggaagcacggaggaugcugggucucuaaccaaaauggaaagcugggaguuuguugagaaauaacugccucaaagagggacaacuaaaaacagucacuugagaggcgacugaaaacccaggugugcagaguagaagcuaaaguccacggccaagucucuggugucugcgugggaguggcuggggagacuuccggccaggagaggucaugucauuguuuaaaagggaaagagugucagggguggacggcacaacauguucauuuauugauaacuccuuucagacagacaggaauguggaagucaauguguccugguuuccuuuggauucugggagaaguguaaauuacugaaccccggcuccaggggacgacauauuuauuugcuauguaaacaaaagcaaaggagaagccuggagaaagggcagaacucccuucgacagaggccagcuaaauucucaugcugucagacccaaagaggguuuccaggggcaacaaccccauaacugucccugucacagagcaaaaagggucagaagaaugcgaaggcuccaaguggggggugugcgcuggaggguccaaaacuaacaaacaaagcaaagauccccuugaccugguggggucagugcuuggcaaguuuaagagaaaacagcaggguggcuggugugaggggacauuugcagacuugguccccggggucagaagaccacuagcuagucuaguuauguuauguucucuucaaguucaagaaauucauggggucaaaaucuugaagucaugaaaggaaugucggaaaaguugacuauuucgcaguuauaagcaaugaguuaauccuacauugcaggggggagcugggggggggggguccauuuagaucagggauggggcuucugagucucaaggccacaucacuguaccuuuugaagucugucucauuauuccuuuuugguucuuucggaaauucugccagaaguauuuauuuuucuucuuccaaucuccuuugccuuuaagaaagaaacaaagaaaaggaguguguauggggaguggggggaggggggagagguacacaagcaguaaauucacuuaguaucaaaaguagucucuuucuuacaaugucagagcuugaacaaauacucugauuucacaaaagacaguuuuuugguuugugaaaggugggagaaauagcugaaaaaauaaagugguuuaaaagaaaauaaauuuccuaguagcaaaaagaaaaaaagggugggggggggaaaagaaaagaaaagucgagauagagauaaaaaaagcaacauagaagcaucagaagggcagggcgggcgugugcucuugggcucacuuugaaguuuguuuagccagccugccuucugccuuauauugggggucacuccggaccuuugguggcagccacaauuauuuccacucuaccacaaauagaaagcuugcagaaguccaccuuguuuuguuuucuuccugcugccugcucaccauugcuuucucuuucucuuauugcaaacuuaaggaagaaaacacacgggcuauuuauucugcccuaguauucgcuggucagcacagcuaaccagccugguucacugcaguguuuggugacacggaucuauagcccagguaaggcaugauccccaacucugugauguuuaggcuucuuggugaccgagcuacagauuaacacagucacaaagacaagagaaacagaggccggucuugcuuggauuucuccuagcucucugccccuuugaccucccucucgucucagacuaggaucaggugauucagcaaugaaaauaaauuugccaccgguagacauuuuuuaaaaucuauuaugguucuaggaguugacaauacaaaauaccuuuuuaaaagcaaacagagaggcugggugauagcuuagucagugagcagauuguaacaccagcaugagaagcaaaguucaacuucccagaaugcacuagcuugaagcugggcauggggcacauaucaaaaccccaucaccaaccaccaggcagacgcaggcagguccugggccaaccaguccagugaccuggugugcucuaggccaaugaaagagacuguugucucaaacaaccaggcucccaaggaaugacaaucaaguugucugucugucucugucuuucuaccccucucugucuuugucacacacacacacacacacacacauacacuuacuuuuaaaagacaaacauaagggaagacagucagugaacaggaagaaaguucuucauucuuuaaaaagaggaggcaguggcagcaauggcugccaccaugcugauguggcaugcccugcccaaacugcagcucugucuccauuugguugucugucugguugcccugugaccacuggaagcaaggcccagcaaaguagcggcuuccacagucuagacuggcggugccaggcagcgaagcauggaguagccaagugagaacuccaucucuggugcucccaagcuagcaagggugucauuugucacaacaggauguccucauuuagaugccgacagcccuggaggccugggaaagaaauccaagcccuucuucugccuucaguucccuaggcucucagauccucaaggaucucagauccuaguuucguggggucugcugcuggcaagcgaacccugaaagcagacaucagccaccaaaagugaaagcagauucggugucgcucauuugacuuuuccuuaaggaggcggcuacagugcauuucucuaucuauaagcuguauauucccuuccuucucucucauauaugugugugccuccugauuaaaggagugugaucagaggcagcucaaauucugccucuguaaaauggagguaauaaaaguagcuaacaucuuuucagcacuuacaauuacccaaacccuuugcuauuuaacagucuaucucucuuaagucuccuguuucuccuccuccuucuuuuuaagugcaacugggccuuauguagcucagacuggcuuagaacucaacaccuuccugccucaggcuccaaugugcugagagcacacuugaguccuacccuguucacugcugggucagcauuuaugauucaaauccugauggccagcguucaguucuuguuacccacccacccucuggccuuugcuauaacaagaguagaucuuauaaucaaggauauauauaauuuauaaugccuugaaugcauauuauuuuaucuacacguuccaaaugucagagggcaucauuagagaaacaaaguuaagaaauucuccugacagggucaugugcucaugacagagaaaauuaugaauaagcuagcaaaagggcugguggaugagauuauggcuuauccaauaugaugcagaaggaagccucucucugcuaacaauauuuaucagguagaaauauucauaaauggccauuuuugaagacuugcaaaacaguauguagaccaagaugcuacuuguacuuucaaaagaacaauccaugcugggcagugguggugcacgccuuuaaaucccagcacucugggacugucuaacacacugagacguaacucccaguggaucucugaguucgaggccagccuggucuacaaagugaguuccaggacagccagggcuauacagagaaacccuaucucgaaaaaacaaaaacaaacaaaacaaaacaacaaaaacaacaaaacaauucauaauggcagaaagagaagaaaauuguaugucaaauaccagcgucagagagacggucagcuuaggcgauacagugcuugguaaaaagcacauggaacugagcuuggauccucagcucacacaguaaaaaucacaucaugaugccauaugucuauaacccuagugccagggagaaaggcaggcagguuugcccagaggcagauggcaaacuggaggacaucuagugugcaccucaaccauacacauacaugcacauacgcacacauauaaacaaacgcacauacauaaucuuuuacaguaucuauuucugaauugacagaugaugauaaugaugaugacuucagcgaggucuauaacucuacaugucuagauauccucuauaagcuaugaaaaugaaauaauucaguuaaauauuuaaaucaagggcagugguaccuaccuacacagccgucuucugaguuugauuuauggagaggguaccuaggaaagaaaacacaaugcauauauauuacuagagggccuugguuuuaagggauuuucacagaaaccuuccuaaccuguuggaccuuggcccaacagugcguaacggaggcgggggaaucuuuacccgugcucuuucccaucucucugcugacguaauagaaaauggauaccauuuuucaauacugauuaauaaaagacccagucuagacaggacuucuauuuaaaaauuagacuaucggugucacuacaggucgucugucugugagcucagcacugggaauguucuuugccgcaggaacgucuguaggguaagugaagaagaguauguacaucagagcaaccauaucaacaccacagcacaguggcugcuuggcagcuggaaaacagaucuguguacacagggaaggugggagaugcggucaaagucagacucaacgcccagguggaggggcagccaguagagagcuccuguaguuggugacuuccaacuggcaagggugacaguugguuuugccagaucuuguaagacucaaaaucaagacagagaucugccagugagagcuucaugcuuuggagccauggcagauuuuuuuuuaaugcauccaaguuaaucaaccugugucuguuuggcauucuaccuugaaccaggcugucagcgugagacagccgacccagguaaccccagguaauguggaauaguaacagccagugagugaggcgcuucucugggaagaacucagacaauaccaacuuagagcacgauagucggagaagcaaagaauauuaacauggggcggguggcaaguagagaugagaucaaaauccucauucgcuggauacaaacuguagaggacaacguuggugcccuugggcaugccaaagagcuugcaucagaggagaaguugggaacuuagagacuuaacacccaaaucuucucuccaaguucacugccaaaaagcaagauuuaaaagaugcuuggcuaaacacugucucugcugcccagaaagccaguugugaggccagguacugagaaaugagacugagaacagucagaggaaacguggcagaacuguaaacaucuaacagagaccuugcagguccaggggccucaaggauuuaaggggcagaacggagaggggagguuucucaugcaguccccuccuccccacccccgugaucaaggcauuacuuagauguccgggcacugauggugacagguggguugguacccagaccccgugaguaacauagugcuccacacaaauacaccgucccacuucaguaagaaaacauacccaucaccaaauuacgccccucucccaaagcucuagacucuauuuucccuccuccuuuguacugcaaaaauaagagauucaacucacaucuacccaaaaggcugcccagcgguagccauucuaaguucuauaaacauucagacaaaauauaucuaacaauaucacauuagggacaaagguauggagaaaugaggcuuuggguuagagaguggguguuuaugaagaaggaugcuugcugggacaaaaaccuaccucgguuguuugaaugucugucuagcacacccuggguuugacccaucacugcacagcacugacgggaguugguguucuuuuguaaucgaagcacuugggaagugaaagcaggagggucucuacuacaccaaggccagucuggaguugucucaaauaagcaaacaaggaggcauccaaagaugacggguggggucugguuggucuugacuggagugcaggguacaaggagaucaguaaagcguuucuagauacgucucugaaaguccucauagauagggaacuaaggggaaaggcucacccaccugaauauggguuuuauuaucuaauaggcugaagccuagaugggcuaaaaaguggcaaggugacagucuccgugaucaaggacuccacaguaagucgacauuuaccagacauugugacguaagcacuguucucaccgcaugccuccugcucuccgugccuccaucuuaccucaguccccaaacaagccaaagcaggagcccaaacaaaucuuucucucuuguuuccucucugguccuugucacaacgugacacaauaauacacaccagaagucaaaaaagcagggacaacugcaggcucaugaccacagguaaauuaugagaccaacagagacugucaagacugagccaucggcuggcuauguggcaggacauggaggaagggaaucuuucaaagagugaucaucuuugggcuguucgugaauuccuaggaucugaacgauacugaccauugcuaagaaccaacuacgugagauaucugcagugcugcuuaaaaccagcaccaaugaggucagaacuccccagccauuuuuucuuacaccgaaagaaauauguucucaggcaaauggucugcagaaaucuuuaacuccucugaagacagagaauaguagaucuuaauggauuaagugacuuuuaacuaucacucgauguauauuccgauuuuauaggaagugaugguccccacgagggaagguagauggacagcuuguugcuugguggccacuuggcagucccuagggauuacaccaaguggccugcuguggccuggcugucuuugaaauguaugccuuucucucucuggguagaaugaagauuaaucauuucaauccuaucuuugcuauuuucgaaagcuccuuucuaucccaaagccaucuuuccauacugucagacaaaugcuaauguccacucccauaaauaaaaaugcuuacaaauuugccauuaaggacaggcucguucucacugcuacccagacauuacaaaaucuacucauaggcucuaccccaaaguacagacuuuguuacuuucauucacucucuucaaauuaucaugcauguuggguaauuuuauccucugguuuguccauacccacacuuccugcauugccccagauggccugaagauggcacuguagauucuucuuucagcggugaucuagagcguggaauuuuguuuuuaauuuuucacaaguuuacaacacacggacuggcuagugugaggcuccucagcucaccaccgcucaagagagaaaagugacaccauaugcauuuggacagagcauuuggaccugcauagcugaagguauugcaccuagucucaauaagucuggggaugugauuucuuguuuacaggucaagcggucccggguucaaauccaggacaagccugucuuaauucuccagcaggaagucagagugaacguguuuucuaaacuaugguuaagacccccccuacauugcuaauaugugaacauuucuccuuaagauaccuaaacuacuuuggcuguuuucuaaagacaaaacucauuuaagaaaauuccuaauuuaaggaauuauuggauuaagaaaagaaagaaaucaagggcgcauauccucagaacguggaccaugucauuccuucguccaggcauuuccaaccauccuuccuuucuuccauucgaauucagaccccagugagucaggcacucgcugggccacagggagauuggcuaaaggagacaggugaagcuuugcagcuuuggggcuggggugaggaggcaggaagggcugcagggucagugggggguaguguggggguggggaugggggggggaggaguauggacagguguaggagaccucccugaagagguagccuucuucaaguagagcaggaguggcugugacauucacaccccagcgaggcggaagaacacagggcggaagcgaaguaagagucuaccuugggccaguggcaucaagugggggagaggugagagaaggagccaggagcauaugugagaccagagcugcagacaaaagcuuaauagauauuagucauauuauaaaacaauagagacaguggaguauaauacagagagacugggggcuggagagauggcuaagugguuaagagcaccaacuguucuuccagagguccugaguucaauucccagcaaccacagggugguucacaaccaucuguaaugggaucuggugugucugaagacagcuacaguguacuccuauacauacaggcuggaguuaaaacuugucaguguuuauaguuagagugcugcgucacucucagcccaggcuguacacaggcuacccuacuuucuauggaguuucuugcauuagugaagacauccucauuagaucacccacuggaaggaugaauagacacacgucagaauguauucccugagccucuguagaauucaaccuucaaaaucaagaaauguccugcgcgauugccaagcccagcgccuugcagcaucucucaucccuccaugucucuugccugugcacacaggaaggacuagccuaccacacuugcgucuaagagauggacuucaagggcgcacuagaauagacuggcccugcucugucacgacuaauggaccgaguugcucucgagaacucgagaugcuguuucccgaucccaaaucuaaucauacauggauacgugagaaccaaguguuucggggauacuugaggagcuggcugcggggauguugcggagacaccuucuggucugcugacggaaggaaagagaaugaccacaguguguccgacucauuucuucuuguagcuacauuuaaguauccuaaggugcacccaggcaaaaacaacccaucucacuuucacauguggagaccagcacuuagcaaaagcacaauaaaugucgacguucaaagaaaguccuaaacuuaccccaugccaggcuuagugacgcuucacuguaacuaaacaaacaaacauaccugugcacacacacaaaugcaguuauaaccuaauuuguaaaaagcaacauauguuauacauuacuugaaaccuguacuuacagagauuuuuuuuuauggcacaauaaucuuaaaucucaggauauaaaacuucggcgcgaguuuucucccugcugaauuuugaaucggggaucuugcuguuccuguuauuauccagcaucaccacaggcugcccaagugcccccaaagcuagucaccugcuccucgggaaacagagaagggacauagcugugcuacauggugguaaggcugagaaagagccuugcuaggugugugauaguuuggggcuacacuuugagcauuagaaaggcagaggcaagaguucaaggcuagccugggcuauacagcuagacucuugucuuaaaaacagcugacugaucuuaaagaaagcaauuuccuuuuugugagcuacguaaguauaauugauauugugcuugguaauauauacauacuagauauguaugguauuuuuaauguuuuuauuuauucuuggagaacuuauacacgauuuugucauauucuuuacccuccagggauggggccugcacugcagugugguugauauaguccacugggcaaaaguaacugauuuuuuuuuuuuuuuuuuuugguuaucaacuaugauagcuucuuggcuagcagugggacuuuguguccacuucuauaugcaaauuuucugagacagaguuucgugucccauggcuggcuucuaacuugauauguggcugaagacuggcuuugaauuucuccuuuuuucugccuccaucucccaagcacugagacuauaggaaggcgccacccaccccauaaucacgguaggcaaacaauauacaaacugagccaucgccccuggccuaaugaauauuacccauaagauagcaaauccauuuuuuaucucgugaacauucuucucuauuuaauagaaauaaacacggaacaauauucagcuaauaccaucuacuaccugccauaaaaacucaagaggucacccagcugcagggacaagacugaagugaggucagagacagaaagccugggcaguaaggaaacgcucacuuucaagguugggaagagacagaggcuggcgcccccuagugcucaguccugcguaagucucuugcuugaggccaaccgugggccuuccuaguggaaagucugcauuucacacacaucucagugcagucaauucuccaacugugagggagaguaauucucccccggagucuuagaacuccauaaacaucuacugcaaacagcaacaccagucauauuuuaucaacccagucaaaacacucucuuauucagacauguuuuguuuguuuuucauuucagaguccuuucucagcuagaacuuucuucuucuugucuuuaguucagcuugcuggcuuuuuguuuugucugagagagcaucucacacuguggaccaugcuggugucaaauccacagcaaccuucaggucccagauuucugggacuguagguacaagccaccauucucagcuuuggccuguaguuucuggcuuucugcuuaacaaaguaaaaagucaccuccauaaaugaucaaggcgccucguguagugugaaauccaaggcaacaagcccaucccaggauaagagucacaugcugugaagucaagcagauuuggggagaggcauauucacaccuugaugacgcuggguaaaguagcuauaguaaaauggcuccuaccuuacuaggcuguugguagaugaucugagugcauaaauggaaacaccuucuguggugccugccccuugggaauauccuuguaaaugacaccuauguaaauauccaucagagccauaggcaaacugaagccuccagcguauucuacaaagcucaccuuugcggcuccagcacacaacucuggcauacaccgccuccgcuagacuaagccauuucuggucacugaacugucucagugcuaauuuguuuucaugucaacuccucuccaguauuuugacauaguuauuucuuuuucucauuucuagaagcgacuuauuagaaucccaacauaacauacacucggugauggagugcgaagucaaauguucuucgguuuauuuguggcgugauauuauuuccauuuguuuauaucuuauugucggguguguggaagcaauggcucacugguaagagugcuugcugcucuucacagguccagcaucagggcccuaacaucuacaucaagcagcugacaaccaccaccugugacucuggggaaccccacgccuucuucuggccucugaggguaucagugugugugugugugugugugugugugugugugugugugugugucugugucuaaaauuuaaagacuuuuuaaaaguuuuuauauccuacugucucccaguccaguauuuagcuugguaaagaacaguauauauuaauuucuuuuuacuaaggcugagaaguuuuuucaauauggauacauuuccuagaaaauuauuugaauccaucaauuaugucacauuaacuuucuacaaguaauggcaggcuuuucaaguuuaugaaauauaauuguugucacaacaguacaaccaacccacucuuuaauucugcuauuuacagaucugggaugguuaauuuuaauugucaacuuggcacaaccuaggaucacccaaggauaaacagucuuaaugaaggacuacggagaucagguugaccugugugcauguuugugggagauugucuugauuacacauacacugauccgugaagauucagcccacuacgaguggcaccauucccuaggcagggagccuuacacuguaggaguaaagaaacauagcucuauacaaguaugcauaaacuuauucucccucuacucuugcaugugaucuagauaagcugcuuugaguguuuacacuagcuuuucugcaaugacugacagcaaccuggaauuacaagugaaacaaacaaacagccuuucuccccuaagcugcuuuugguaaggcauuuuaucacagcucagaaaagaaaggacaagguccuguuaccacauggcauaaauucuuaggcccagaaacugcugaacgcacauggaagacauuugaaaucucaaucuaugaccuuuuacaauuguaacuuuuucuaccucaucucuuuuccauaauuuccuugguucuaauuauccucaaaaccacuuuaaguaaggcuacuccuuucaugagaugucucaaaaggacacuggauucagaaaacaaggagaugaccugcauggugcguagcgcaugccuacacaugcuaagcacuaacuuaauaaaaacccgaugaagagcaguagcucuucuuccucggcuuugacucaugcuucucucaaaccuucuuaaaauguucuuugccuucucagcuuggguucucuggcaccucugggguggacaaguucuccaagccaaaaagcagaguuccaagccuucugcaacugaaaacccuucacagagaugcacucaacggauguccaucuuuucaugcaccagcuaguaacuuguccugcaaguuaaugauucaggcaggucacuggcagaaaugcaaaacuuucacaucuggcgagcagccaaaugccaucuauccacaguggaagucugaggcccgacuguguccgggcuacaggcuuaugaaggccaggacuuacgggcagaaggauggaggaaaucaccuugugacaugguuucagguuaaggguuagagacaugcaaaaaccaaauccaggacagguuuguuuauauccuuaucggcauguugucccucaauucccaggggccucucacugaggcuuacuuuuccauaugggccauauuuuucccuuauuuucuucugucucuucccccuuccucuuuguaucucuguuucccugucuuggacagauucgaauguaggcaaggcugccucaaacuuacuguuuagccaagggugaucuugaacuuccaaucccucugucuucaccuucugaaugcuagaauagcaggcaugcaccaucacauagggcuuaauacauugcucgaggagguaccaagggccuuaugcaugcucuguaggcaagcacucuaccaagugaugagcuacaucuccagcucuccuauuuuucuucauuugugacucaaugguucagaacuaagaaagaagugacuauaaaaagggauacauggaugcuagcuuugcugguaauaaucauugauaguaacagaaugcaacccaguaucuaugauaaaugccuuuccaguuccuccaaaugaagcaaucaaucuucagaacaucuuuaugacacacuggauggcccauaauauuuuaaguaagaucauauagaaaggaaucaugaccgauuauuuucauauaaaaaugaugucaaugauggcuuguuguuugcuugguagagauaaugaaguucuguguuacuugaugagggaacuacaucacaguccaguacacagcuuccaugaguccacaauuaaucaaguagauuucauuaacuugcucuaagguaauaaauuaacuugccuucuaacucaauaacuuuucucauuuucuuucuuccugcuagauagagucaugauuugggcugggugggcagcguacucugugaaacauuuucuuggacucccuugcagcuaagggagaucaaguauccccucacgaaggaaagaaacgcuagaauuuucugguaguuuuaagaaaguuagcauuugugugauuaaaagaacuaucucaauauauacacccucuuccuuugcucuccuucucuacugugucugaaacacaggaugcauaccuaaguagucaucaguuaccauaaggaagggaaucacacuugaugguguagcagagaggaaggaauuccagcucaaccagucuuggaauucugcccuacaggguccuggcuauaggagaaugugcagcuauuugucagugcugaggguauauuaaccugaggguauauucauaacaaacacaguugguuagugaaguaagagagagagaaacagacagagagagacagagugagagucagucaugguaguccaucccagguaauccgaguacucggaggcugaggcaggaaggucaugaaucguaaccugagcuacagcacaguaagacagggcucugucuaaacacaaaacaaccaaacacaaugaaaagaaagcaacagaagacaaacuuucacaaagcacuggucugggcgguuggcaugcauaacucaucaucuuucaggcccauggggacccugagaaguacgcaggugaagguaccaaggcccgggugcuuaguuaagggaccuacccaaggccacgcaacugacacaguacucccuugucuauguggguuuuuugcuuccugaaguuucuguuacccaugggcaaaugugguucaaaauaucgcuauuuuugaguaaucuuacaaaugaacaauuuagaacauugaaauaauuucugggcggagacuugggacagcaauaaaacacuauacuuauaaaugauagacaaaaaaacaauacuguaaugcaguguauuagaggggagacagcuguuaacuguugaguuguagcgccaaaagguaaacucggcucuucaaaauguuuagccuaguauuuuuuuaauaaaagcugggauccaugaaggcagaggucacaucaucacccuccccacuaucuucaaagugcuggguccaauacagugagcucauaguguuagcaaugaacaggcaauacagguuuguagaucagccucugaaaccugaagccucauagcaaacuuuggccuuuggcucaaaaacagacacaucauuuuucucaucaucaccaccaucaucaucaucauguuugucguauugaaauaugucuauuuccagcaccagcaugcaguuaaccuguaaagccagaaaagggcuaccggugcccuggagcuggaguugugagcuaccugguaucccugcuggaaacaacuacuaacugcuaagcccaucgucccagccucaaacucuggcuuuugaugacuccucaacaggcauacaaauaaaggcggaaagagccguaaagaaccuugaauagcuuguucauacuauuuacugcuccuagucaaucucuccgccuucauuuuacagcucccugugaacuucagcuuuuauuuagguuuuuauguuuucagaauuacuggguuugucuaaagaaaaagaaauuaaacaaaacagggcugggggugugucuuuucuccucaaaaaucuacuuuccacaaaacuaaagggaaauauaaguaacuuuauaugagcuuaaauagucuaagaagaagaaaaaugaauaaaccaaaacauguaggacuacggaguguagcuuaggggcgagcauuugucccgugugaaggcucagugugaugcccacacugcaaaacacaaaggaaacaaaacaguuaaauaguugcuacucguuuuguguuugccacaaaauuauuuuucccucuaauucugcuugaggaguuucuaaaaauguguaauaaauauauugggggugggggaugggggagagguuucccagcaaggaagccuggguuggagcuugacugaacauauagacaggccaacucugcauucggcucuggagaccaaguagcuaucagaccugcaggccuggagagcccgggugcaaaugguagcauuugcuacuuaccauucuuggccacgggaacucuggguaauggaucccaggugaggcgagcugaguuuccucacaaagcuauuaugcccuacagggaaaacaagccucaagaggcagucuuuaccagguuuggccucaggguggggaggagcgaggaugagaggaagaaaaaagagacuccauucaauuaucuccuccccgguuuccaugguaauggcuccggaagcaggucggaacuuucucaguggaagcaaacaggagcucccauucaccagcacccaagccugcuggccacacuagccgcuugugcggacgcccaggcagggacaggggguuaaggagccuuucuucugucaccugcuccggggacaggagcgguuggggugcacuggugagacugccgcugaaggucaaagccagagaacucuggguaggagcgacccuuacucuccuugcuagaggcccuucuggagaccacggugggagccuccugccugcccuacuucuagcccgcagcacaaacaaaguggugaccugaaucugggucccuuccacggugacugccagcagagccacuggaguuuuguuuucuccccgacacuuuacauucuuugacagagacaggugaugacauauuugugagaacaucuaaacacaauggaaaugagacccucgccuuuccuggcucgucauaucuuauuuugaaauuccucagcauuaucuuagucacucaugugugaaagcccacugggcaguacacacacacccccuuaucuuauccgcaggcugcuuuuaccucgccuuuggauggcuucguaucccacccgcuucacaguccgugguuguauccaaggcaagcauagcagcaccugcuagagaagaacaggaugccaggaagcucugccacgcucgucaugagcauaggaccccccugcgccagaugacugccccccccuaaauuccaccuguguuugagagacagagcccuaacauguggcugaugauaagacucugguuuggguagcauuuccuaaaacccagcuggcugccuagcacuccacuguaacacccgggucugucuccaggguuucacaacugcggacuacuccaccagccuguggguuguccuuucuaccacuucagcuguuuccccagguguggauauggguggaagaauggugucaaagagagacagacaggauaguaccagcuggguucuuuuccauuccuccccgcccccauccuuauaacccccacauuugagugggaugagaauuucagucaagaacagaaugcugaacaacccagacacaaguaacccggccacuccuaauagugcccugucugucugguuucaucuagacaaggcugugauucccagcucggagguacuccuuaaagcacuaaugacagaaugagccagugaguuaaagcauuaagcuacaagcacggguuaaaagaggcccggcgaguuucagauuuucaggcuucccaccacugagucaggcugcacugaagccaugggacauccacuucucaccaauaaugguccuucccacacugugggccuccugggcuaccuucugaaggcccaccaagagccagaugcgaaugcagacguucuccaagcagccuugcugguccugucuugggcuuggaauucacuucuucucuguucugcugagaaacccugcaggaguuuucagcucccuccuuaagaaccugacauggaguaggcuggcacagcuccacugcaucaaaucuucuagaauucucuucccuucauggauuccggggugggccaccgcggcauuuucugggaggugcagacagcggagguggagggagccacuuucucucugcccuucaaggucagcacaggcaugaagaccagccguggcuagcaggugucacugcugcucccuugggauuugggcagccugggacagcaacuggucugugucgcucauaauccuguugacuuacagacucgaggcauguugacuugggguggggguggggaaagauaccaaaaacuccugcgguccucuucgaggauggauuuaaacauucccuuggggaugcugacagacgcuguggacgcacacccauccuggcuggcugcagucugucuuguuucucccacuuuacaugcauacauuacaagcuaugccaucugacaguggaggaacugccucacccagacuauggaaccagccccuacuaacgcauguggucaaaucccagaagagcauacagugugggcaugcugccucacugagauccuaaguuauacagccuuaaaugcccacccuccaaaguccuccccggcuccucuuucccaugaugcuuugcacgcugccuaucacuguuuguuucuaucuuccuacuuccgggaucucguagguuugugcauaagccugaaaugggggcaguguuuauuaaauuaagucuuauuagcugccuagcccaucgagggucuuuccaaaggauauuacucuuuuauucuccaagaaguaaggaaggccuugcugccugcagacaaaugggccuggauaggagguuuugaucuuccucggccaagucucauggucuuagcaaucauauaaccuuucuguaccuuggucuccuuaacuauaagcccauccaaauuauagauuaguuagcaggauuaaaaagauauacaaagcugggcagugguggcacacgccuuuaaucccagcacuuggaaggcagaagcaggcagauuucugaguuugaggccagccugaucuacagagugaguuccaggacagccagggcuacacagugaaacacugccucgaaaaaccaaaauaauuuaaaaaaaaaaagugaaaagagauaugcaggauggaggugggggguggagagauggcucagcaguuaagagcacuuucugcucuugcagaggacuuggggcuggcucccggcacacauacaguggcucacaaccaucugugacuccaauucuaggggauccuaugcucucuucugaccaccacaggcaccaggaaagugugcuguguacuuacacacauauaaguaaaacacucaugcacauaaaacaaaaauaaauaaaucuaaaaaaggaaagagaggcacauggaucgcuugguaaacuccagucaaguccccucuuauucugccuguagccugcauauagaugugaacuguuuucccuuccuucagcacuggcccaauauucucuucacuucuagggcaggaggacagacagcagccacaucuauguguuaaacauccuuggcugcagugcccaucccccuccaauggcagcacacagccugccaccucgcaggaagcaacccgggcacguggccuccagcugggguuaggccagcuggagcucacugaucagacagaaugaagagcaacaaacagccuucucggucaggaacagcugaggcagggaacauuaguacagcugcuguccaucccccagucccugcauucaggaaugucgagccccucaaauaugccacgcaauggcgugcacacauguggacacagagaaacgcacaaacacagacuucagcacgcugagcacauugggcuccagcaaaguggcugugauuucuuagcuucuccuccaacuugugaaauuggaaaggaaacaaagucagguggaauaaugaaaguuuaaguggccacugauugguucuguguauggccccauccaugacagaugcccuaaggacuucugcugggagcagcacagcccccuaaggugaggggacaagcuagguacuaugcuggguaugggccagcccuugggaagaccuguuacuguguccaacuaaucuauuaggagcucaaagcuuaaaaauuucaaacccacuguuucugaucaugaggcuagcagagcugaaguucagguauagauucugcugggcucuagagcucauaccaaccacggaggcaaccccaacaucacugaggucagcaaauggaaggcacuugaaguaaaggagccuccagaggcuucucaucccagcaagguggacguguacaagggaaagcccagacuggugagcuguccuggaugaaucagagcggggcgagccuucccucaaacuccuggacaggaccuugcccuuaugcccuuggccuucacauacaugguaauuagcaaaacuauuaaggcaaaagaacacacagcccauaugcuaauacauggcuuugguccaacacacuuaucuccggaaccuaaccuaugcugacuacaguacgaggaccgaauuaugauagcccaggccguccugguucucuaugguacuguguccaccucccaagacagagagacugcagagaagccagcccaucucaaacaggcaggauaacuaguuaacuuguucaagggcacaacucaugugacuuccucagacccaggccuggagcaugcaggccugugccucaugggaauacugguggcccaucccaccccacaucccugucacaaacaggauguagagacaggaugcauuagucucagcuccagaggacacggcuugaccuggauuuccuagcuaucucaggcccugauuuguucuuuuuagugaauacguucuacuuccaaggaugaagaaccucuccaccugugaacucccacauccaggaagguagugcugaacccuggucuuguugcagaaaggucuacaugacaccagacaacucacccuguucacaggcgggggaagccccaacgcccuccuagagccacgcccacaaccaugccuguagagaaauacuauacuacaaagggaauaauuucuuacaaguuucuaaaagaguuagaugguaaguuaccaagaaccagacacaagggucuauuauuaauagacuuaauauaauaauugcacuaucaauauaauaaauucucuuucaaaaguacauuuucuuucuguuuauaugacacauuuacaaauauauauacacacacacacacacacacauauauauauauauauauauauuaaccaagcugaugaagacaagaacacauuugugcacacagagacccacacacaaacggugacaguagcauucuucccagaaaccaaaggugaaaacgauacaaaugccuaucagccagucauggguaaagcgaaggccauaugggcaugcguaggggaaugcgugcaugcauacagugccgcagaagcugcaaacuguuggaaaacaguaggguaagugacaggaagccagcuaccgacuacuguggugacgucuuugaaacucugagcauacuagacacagcugaacagcauccuuauugccugugugcagugccagccaucaaacccaaggccacacaagaguguucuacauucccuaacuguguccuuuuaauggaaggacugcaaggcauacgaauuacagcucaauaaaggaauuaccaaagaugacauaaaagcacuucuucaaccaaauagcuucuuucagaagcuaaaagaauugaacaaguaugggguuuuacgugauguuaugcgguguuucugcuugaagaugaagacaaugagaggaggccugaagggugcaggauggaaucaggaggagacuguccagaaacagaugggaggauagugaaagcugggagucucuccacuaaguuguuuuuaagaugaccuuuaguguucguuauugcaggcagaaagcaugucauuaagcgaguuucaguuuggggagacacugauacaugcuaggaaaugccaacuaagaggggucuucugcacaagucaugucaugccugggaacaauccguugucacauccuauuucaaagaacccaagucauggagugagcuugacgcacguaucaaaugggcucuaauucgcagccccaagaagauccagaggaggaagcuuuagcuuccugccaggccgacuccugugagguucaagaacauaaucaccagcgccaugggcaagggcaugaacuugagccauauuagacacauaauagcaaaagauaagacuacagaguacuuacugugcguuagauagcuuacuaagugagguaauuacuauaauuacaucccauuuagucaaggaacuggccccaggauugcagagcuggugcccaaauccaaaccccaagucuggaaccaggcaggucaucccuacccgauggccaaagggacaccaagacuggaccggcaugucuguguccagcucuggaaccuuaggcaagcaaacugcucucaaaaaugguaucuccuuccaaggagcucaugaaccauggagugacaagaggcgauuaaaugacuaguauaagaauaacuggcuggugucaaggaugaauccagaaagaccccgcagagcccgaaagcucauaguugaauugccgaggacagaugggucuuacucagguaaugacgagagguuuaaauuauauguuucaacaugucauuccuggcuagugggguuguguuggcagguuauggaaccucugagacagaacucauggugagggauagacuuuuaggcuucggucugacccccuauucccagcgggagcccucugguuccuguucagcuaccaggauguggcuggcugccucauauuugugcugccagggcuagaagcuggcacuaccacugugcucgccacaccgagauggccugaauccuccgaauccugugccaagauaaauuccuccucaaacuguuucuguuggcucuuuggucacagcaacgcaaaaguaucucacacaggggaacaucccacggagacggagagcaaguucagaggcuaagcacaccacacaacaagcccagccugaggaaccugccuggggagcgggugacacagggcaugagguuaccuaguggguggagaagagaauaugacacacugggcucgaagagaagaaggaaggaagccaagucagaagugcagggugggucggggggagucaggcacugagcaagaacucaaccaggggcaacuucccugaagacaggaagauggagaagaaaggccaaaggaguacacagcuuucuaagcaugggagaggggugugaagggaagagggguuaacuaggugggugauaggaaggugacacauuaggaaaaguccucagcugccagacagggcaggaaagcagugcugagcuucacacaugcguggacaggccauucauccaucaccaaguaugucuaucccauccacugcuggagcacagaaucugcucuauugccaccuuuggcuccauuuauuuaucugccuuuucuauugcccuauauauuuggacuuuuccuggccauaaaaaguucaaguguagucacuggaauggaaaaaggugaaacuaaaucagcgaauguucaacucuggggaaagacuuaguaagaaacaaguuauaaauacuggccgacggugaagcuuugcgauuuauuuuagacuuugccuccguggagagauaaaggccggagguccagcuuaggucucagugagugucuaucuggcaccuguuuccacgagcagcagaccguagguuguaacugcguuuuaccuaaugcaaaugagccgccugacuccaugucuuuaccuuucucauugagaccaaacaccuggcaagaaagaagcagggagggagggaaggguuuacuuuggcucaggcuugaagggauccaggucaugaugggaaaggcaggaaagcagggacuugagcuggccaggccuguauccucugccuggaggagggaggggugagugcugguacccaacuggguaugcaaauugggaucccagccccuagaaugaugccaaccacaauuuaaaguaugucuucccuccugucaaaccuuuccaaaacacucuuauagaagcuccgcccccagguguuuccauggugaucuacauccaaucaaguugacaacuaacugaugauuuaccaucacagccccuagccccuaaccucuggauuggcagaaguaaaauaauuguaaacaguuuggcaucagagugcuuugggcacacgcucagccacuucaaaugggaccaaaucuggguucuuauacugagaggcuguguggcuuugagaaacguaauggccucccagugcuucacuuucugugucuguaaaaguaagggacagucaugggcacagcaucacaggaaggggacuggaaguacugggugugaaugaaaugcccagagccauccucggagauaacaaacccgaaagcacgcauucuuguucucuuuuccuauuugcaguccauauggagcaacucuaugauaccaccucugcacagauaaaagaaacaggccgaugaccacagacacugcuggcuuccugguuccuuggucauuugcaacagagaauccuggcauuaccugaaacugaggcaccuggcucauuuucagaucagucuuaugcgcguguauagaacacaaaugaaguauuaggucuuguggaaucucccaccacagggcaauucucuugcucuuaagaauaauacuuuguucagggcaaaaaugugcucggcucucaaaacuuucuugugauccagcaauggaguaacccaauucuuuuuauuuauuuuuuuuuggggggggguaugggugggguggagaugguuugggcuccugguuucggagggucucaguccaccccagcggagugguagaauucggggacucaugucagcugaagcacaucgugaggguccucacgggguucucaggucccugcacacucagucuacccccugccaacuccagugccucaaauccccccaacuuucugcuuuaagcuaugaaacguaugauuuuuuccccuguaauucucucucccuuccgacgugaacuuccuauucaggcaucaccacaccccaacacccagaagacugccugcccauccaugccaaacccggugcucgggaaagagcugcuggaugaaaaaaccaagaguagagacggggauggugugggaagaggcuucuggguaacuuguggaaaggcaugccuuugcacccccuccccuccccuuaguccuugcugucguggccgcucuguggucaugaugacacacucgcuccacucccauuaaaaaagaagaaagaaacagaacaaaacaaaacaagaagcacagcuuggguuucugaaagacuuaagucacagggccaguccuaaguauaugauuaggaacaacaacauggaaaaaaaauggaucuauugaaauuggcauuaugucaguaugugucaggcuuccugacagucauagucuaauuccucauagauagaaagauguauccuagccaacaaaaauaaaaggaaaggaagaaaggcuuugcuuuucaacaaucuuugagaauaacugcuaacaagaaauuuagcucagauucacacucaacaagguagcagacaccgauccagggucggggccaugaagugcauacucuagcucaucaauagguaauuuggacaggcguaaaaauuaagggcucaaagggaaguuuccuuguucccuuaaucuccucagugaaagcacauggcaggagagaagggggagguggcuggccacgcagcucagugacagaucggcuguagcacaugucacacaaagucuccugucuaauccccgguggcacaggcaaaacagaaaccauccugcugaaaaccagggugaaugaaggucuuugucacggaggugauggggugggagaaucccaguuucucuucccaucaaccuaccucccugucugucuuucucuuugacucuuucuugggcagcaaccuagggcccagaagcugacagccaaagcaggcaggaccaucaaggcaggcaaugucugcuguguccgcccuccucuuuccauuccucuccaugacagacuuaccaugccuaccucccuugauccaaguucacuuccuggaacucaagacuucaacaccugugaagugaaaagcaaccuggaaaaggcacuguuuuguuuguucgguuguuuguuuguuuguuuguguuuguuuucuuuguuuaagaaacagaccuuacaucauaagccaggacagacagaucccugucuuagcauagcuuuuaccuggggcagcagagugggugcucugguccucaagacacugggggacacuggaugcagaaggcagaaagcugcucuaggcuugaaguugcccguagccccugagcccauccuuuuguuuacuaaggucucuuacuuuuggaauaaaacgcagaagaacauuucuauccauaaagcaacacucugagucagagaaguguuuuaguuggcagacacucaaaggacacuaaccagacacaaccaacugguucaccaggccaucuuccacagucucaaugagcaacucacugccagggugccagccaguauccgggugggaggaaugggggaauuuuccaguugaacauaccugcacuuugaagcccaaugaguaacuuuuugaaguaaaucgugcauuaaaucuguccuaacuauaucugacugagaaauuucagagugauagcucaucuuucaagacaagacaaagccuagaaccucuuaaaaguauuuuaaucucaaaauaauuaucaacuaauaagugucuucuacuuuacagccauuguguuaaaaauugacucaggaagaauugcugaaccuaagaaccugguaaaaguuugaugaggggugagcagggcuggagucucagauauuuuccuccuagaguguuucaaagaggaagaaagaaaaaggggggcaucauuucccagaagaagccugacagcuaccaugguaagcaaauggucaaaauucagcaucagcaaucaugggauuagugggugucaugagccuccugauguaacauacuguguagaagagaaacaagaaagaccuaacauaagacaacuacccacucuguaaaaaacggcaagagacuaagaaagccuuucagacacugucaugaguaauuuuuuuaaaauuaaaauuaaaaacaaaaaaaaaaaacccaaaaaccgcuuuacaagacagcacugggacaaugagagaaagcugcaagucagaacucacuguaaguguuuguccuggcaaaucccaugugguuccaucacaagaaugucuuucuuuguccuuaagaaaugucaaaggagccaggcagugguggcgcacgccuuuaaucccagcacucgggaggcagaggcaggcggauuucugaguucgaggccagccuggucuacaaagugaguuccaggacagccagggcuacacagagaaacccugucucgaaaaacaaaacaaaaaaaaaaaaaaaaaaaaaaaaaaaaaccaaacaaacaaacaaaaaagaaaugucaaaggacuuaaagguuucagguugugaugugugucacuuacucuccaauagcucagcaagugugugugugugugugugugugugugugugugugugugagagagagacagagagagacagagagagacagagacagagacagacagagagacaaagaauaaagaacacacacaucaguaauugcugguucugaagcggagcuuuguuuugaagguaaaaaggaaugcuauaauuuucaagaaacauuacuagagaaaugaaucagauacuuuuuuuaaaaguucaaaauguuuagaaauauuuaaacaugaaccaacuaaagaccagaagcaaaaugacugcaccauaccgacagggagaaggggucggcggugauguuguaaacagugugugcggugcagauuuuuuguuguuguuaaccucaggaguccaucugucucucccuuggccacaggagacacaccauauuuugaaggaaagaauacuaacagggaaaacaugacuccuccccaccgagggaaaggaauacccaacuuaaccaaggcuaauccaugcuggaugagucaccuccccuaggaaggaagagcacuucuucuucuuuccugaaggucagccccuguucccaaugcuuccccagcaucucaguaccuccaaguucaaagccaaugugcacguacaccccgggccugcuucagccuggacgugacuaggauccuggcaagauacaagucaacuggaacaggggaugcuuacaaagugugugcuuacguucugcucuucguuagcucuuugguuucaaugguguuauucuuuagucuugccccccaagccuacuuggccccuuagguucagaacugcagcuuucugguaaaguggcauucacuccuggacgcugccagcagcacacacguggccggauuaggcggagggggcuguaaagcaugcacgugcgcgcgcgcgcacacacacacacacacacacacacacauaugcgcgcucacccagcaugugccucucauuccuaaaauacuucaucccuaaaccacugcucugucucccuuggcacaaaccgggacaaguggcucugggccagaggaagugucuuuuuagagauguggacuuucuuuaaauuucuuuacuucgguacagucacagguagaacauucuagcaugaugauaccagaauaaaagagaaaagggaaagccuauauauaaagaaguuugguggguuuuguuuuguuuuuuuuuuuaauuguccaaaagaaaugcagaacauauaagacacaccauuaucuuggaugggaguagagcuuacagagucuaaguuaggacaagacaacaaaaauaugccuuuaacagaacagguucaugagccugcgccagcuucuugcacacacaucacauguuuugggauggcguaccuaaacagggaagccuuucaaaaucuacggcuuuacuuaggauuuauuauuauuuuuuuaaacuugguuccuuucugcguuucauccucuauuaaaagcuaacaucaacgaugcaacucuacccccauugacuuaccugaccuuuccuuuagcuccagacauuuauuugggacuccccugcaacuaguuaugcaaaauuaauaacccuccuaaaaagccucaggcauccccagcuggacugcaaaggccacccugguagaugugccacacagaacacguuaaaaacuaucacguccagcuccagcccugagccguccuggaagcucaggcuggggcgggaggagagugacuuacuuucuuuccacuucugguguugacacggcgcugcagaagccuagagacuccuagaagagagagaagguucucgugucagcaugggagaguggagucugauuucuaccgaaugccacuuaagagaaaaggcagaagcaaacuagaugaugaacguggcugugcuuacuucgaucugggaccgcagcugaagugacguggggcuggcgucggguuucuccuaaaacagaacagaugcagcuuuagugagacuaaacguggcacacacagaaagauaaauaguuguguaagaagagaugggaggauuuagaaaacacucggccguauagagggaggacauggcugagauaaauagauauuucuggaaaaccugaaaugcuuuucaaauggaaguucaggacucuuacaacugaacuguugaccaaauuccacugcuaucaucugcucacaaacacacaaacaccaucgacugaaaggcaccgacaauuacuggugaaaggagaauccggacacacuggaccaccauugggcauugaauuuacugcagcuguugaauugaacucuauaacagcagaguucgggccuaauuauuuuauguuuauuugucuauauuucuugggggugauggagcaggaccggacaacacacugguguccuggcaugcaugugaaggucaggggucaucuugaaagagucaauucaugccuuccaccaaguugucuccaggaaucaaacucaaguugccaggucugguagccagugccuucaccugcugggacagcuaucuuggcaaccaaggugauuuuugaaauucuaaaucuauucaaaggauucaaguaacauaacgcuuguuguaaauguguguuagaaagcuggaacacuaauuggauacugcuuuagccuuuuaaaaaaaucaucauauaauacaauacaaaugaacuggccugcuugaaaacuuauaaaagcucucagcuuacagguuaugaaugauauaaaagugcaugaugcugugaguuuauugagcaccauuaaaucacaaggacagagaaaucaauucuagagauaaaaaccauguccuaugacacccugguuuuauaggaaaggauguguuucccuugaaaauguaaaacauacgggagauggagacagcguagcacgugaugugaacagugggcugggaugagcucugaugguuuacaugugaaagauguacuaaggaaacacguggauguaacucuagggaagggagagccuuccgcacagaacagagccucacaagguugauuuuguuuuguuuuguuuuuaagagacuaauucuaaaucaacaccaguguaguaaacaaagguucguauccuaggcaggucuccaaaggcguggcucaagaacacacacuuagaagcaguuucuggcaaaacaacagaaacaaaacacauugacucuucaccugggccauaccuaggccacugcuaacugaaagucugacaccucugccuucacugugcaccugucugucaucuuuacuucagcagaaggcauaaagcuaaauccugauccugauccuguagucaccuuggauuccuagaacaggauaauaauccauaggggagugggauacuacgcuauuacuccacaccccagaguagcacuguucaucuuagagaccagagcuguccucuugcaugcaugagacuaagacaucuucagcccacccucacagagccaaaacaauggccaagcagaccacauuuugacagagacugcccaccuaugcagaccucugaucuuccaaaagcaccugucaguacccugaagacagccuuggcgucacuggaucuuuuaucugcucuaccaagaguggugacgcugauuaaaauuuucucucugcuuuuaaagauuacucuuugacauauugagaugagcagcugagccuauugagaacugcuggggucagguuucugcccuguaaaacuccagcuacuguaagaaggugugugugcgugugugugugugugugugugugugcuguuagaaaucauauuugaaccuuugauuuguaagaaacccgaauucuuagcaagccucaggcuuuacccucugcagccucggagagaccaguuaggcagaccuggcauuuugaaacuaucucuuugaggucacuuagaagaugggauaggccaguagacagcccucccuucucccaucuuuaucugucccuccuucuaacauggccacuuagaaugaaucuccugugugcucauuaccauucccuaucucugaaauuagcauacuggggcuaaaagccucagccuagaaugcccgaaugggcagaacucaaguuaucagguuaugguuacccaaggcucuggcuaucauucuccucuaucagccagcugcaauuugaugggcgcacgaggcagaagucgucuauaguuuauaguagucuauagucuauaucgaaugauuccaauuucuucaauaaucugauuguggcagcuuuaaccacuguucuacucuacaggacuaugguuugauuuuaggagcuguuugguucgccucaacugacaucuaggaagcagacaggucauggucauggucaugggcagugauggguucucaugggccuccguacuaaguucacuaggagucaugacuagcaggaucauaagagagcagcagaggaacuuugcugaaggagggaaguagcagaggaaggggacaauucagaguaaagccacagaugugagcaugcggugggaaucacgcccagacacaggccaugcccaucagugcgauuucucccggggugaagggguggguucugggaaggcgcugcucaaugcugcauguggugggugacccuguacaguauacacugaaagcagaaggaggguggguugcacgcuauguaggcugguuuuuguuuuugccacaagaaaaacaaagaaugugccagaauggguagaucugaggagacgacugugcacaaacaacccgagugaggaaaacacauuuuaugggacuggcugcucgcucaaccucucagcccacaccccugcauaugaagcacaauagaacuucacugcccuaaugcccugccggggauugugugugugugugugugugugugugugugugugacgggacgggaagacucuguguguguguguguguguguguguguguguguguguguguguguguuaguuaucgugacggaacgggaagacuaugguguaccacagacuguuuauggaggucaaagaauagcuuuuaggggaccaguucucuccuuguacuguaggcuccagugaguuuacucagagugucacuuuacccucugagccauccugccagcccaucccccugguuuuccuacuugccauuugucuagaguauuuccauuucuguagcaaacuugacacauauauauuuuuuuaacaaggcaguguuucuaacaugucagagcuauguucaaaguccaacugguuggcccuuuguggucaugacugcuacuuacagcccaaucuagaaagcagagacuuaggcauuggaaacaauauauagagaacugucaagcuuagaaugcauuucuguaagaaaaaaaaagcacuauuuucaaauauacccagcucaaggcaaaaccaguugcuugacaagguucaacagaugugcacaugugugcccugcccugcuuguccagguggacacaugugguguccaguuacauuaccagcacgcaggucaaaugcgacacuaaggccuucaaugaauauuguuuuucuaaugugaucuaaccugcuaugcuguaacaccagacuccaaacccaccugagggcagaauaagguccuggcaaacagcuuucaugagccaucccucucuccagcuguuuccaagaaauuguggaaauucacauuucucugucccuauggcugccagaaucccaugccaaaugaacuuuacagcuggaaaggaaggagggacaaaccacugcgcuguuccagagacagaaaggaagaacaccaagcacccaccagcucagcucagggccaacuccuccuccacaaggaccgcaaaggagguggacaaagccaggcuccauggcucacagaguggaacgugaggaaaaagcaaaauggcucaggcucucacugguaagcugguuaaccagggagcccguaguccaucucgguagagcugaaagguccuuuagggccagggagauggcucaguagguaagcgcacucauugccaaaccggagaagcgaaauccaaccccuggaacuacaccgcaaguggagagaaccaagucccugaauccuucugcuccuucccugagcucugugugugcgugcacacgugcacagaaacacaaacgcggagcagagcaccucacauaaggaagcuuugccugagaagauuucaacacgacuaccucugacuuucaaggcuugggaggucuagaagaggacacccaguaagcaacaucuggcccucacacccauacaugugggcaacauacacacuuacacucucacacucacacacacucacacacucacacauucucacacacucauacacuuacguacuuacauacuuauacucucacacacucacacaugcucacacacacucucacacucuuucugucucucucucugucucucugucucucucucucucucuuucucucucucucucucucucucacacacacacacacuaaggugaaagagaauagcuuaggaaaauacccaacacugacugguagccuccacgugcacacacaugcaaggaacaccugcaugcaugugugugcacacacacacauaccucuggaaaacaacaacaacaaccuauaacuagcuguuauacuaguugagaaagaaaaucaaauuaaaaaaaagucucaggagguugagacaaaugucaaaguuuagcccauggcaaacuuuuuauaacacaugcuugcaaaaucggauuuauaauggaaacacaggcagggaaggcuccaauguaauauacauaaaugauauguuucuguucuuguauuuucuucccuccugagcauuaaucuuugaaugacuuacucuauaaauuauugaacuuaguucaaaagcaaaugaaauuuaaaauacccauuuauugaauggcaaaagugccauguugaaauuacugugauuuaucuguuucuuuaacgauuccuguagcaaacuuacuucauugcucaaaauuauuaccuggaugcauaguuuacuccggucuaaacauaaauccacucucacuucgcagcagcagccauuugucaagaucuuguuagcuccuucacagccacgaggccaacuuuugcucucugcaacucuaaacugcuccgcucuccgccguaccaaccauuacaguggggaagggaggaagcaccaugggauagaguccacucaccaggcccaaaaguccgcuuaagauuauccaugguugcagcagcucagacaggaagcagagauuggucccguugaagucaauccacaauccaguggauuguuaauggauggucaacccuccucuaugugacuggguuuggaaugacuuggaagauacaagccuaggcgugucuuuaaggacacuugcagagagguuuaacugaguuugcugaaugggcugggcuauccugcuccauaaagcggcuaggagaggagccaucugggcaccucacucgcccaucaguaacacaguauaaccaaauguccccugccaugccucuggccacugcagacugcgucaccucuuaaugggaugcaaauaugcucacccucaacccccccccacuugcuuuuuguugguguuguagcuugaguuugaacacuugugcugcaauuugggaggcucacuagaggaaguaugucacugggaccaggcuucgagguuuuacagccuggccccaccucccguuugcucucugcuuccagaccgaugauguaugguagauaggguggccuuguggcccugcuuucaggccucacugucuugaggcccucuuaucuucacugugcaugucaaccaaagcaaauccuuucucccuuaaguugcuuugguugagguauuuaugugugugugugugugugugugugugugugugugugugugagagagagagagagagagagagagagagagagaauaacuaagacagucaaguaguuaguugaucauaguaaugggaaaagcagcuauuguaacaaauguuuguuuacugagcauuaauugguacugugccaauacugaaaccacugaagccaggacauugcugcucgccagugagagaaauuccagucuauauagacuacuucucuccauuaccuagaggaacucuuucucugucuuucucugugucucugugucucuaucccccaccccaccccaccccaccccacccacugccucucucugggccuggugguguagcucagugcaagaauccguguuuaguacaugugaggcccgggguucuaguccccggucuauggaaacagaacaaaaaggacacauuuccaccuaaggauaugccacaucggcuaauggacgaaacggucaacauauagacuacgcgcgcuaaggagacggcugcgcugcagaugcacacugugaaucuguaaaucacacaugugaaucuguaaauccaucccuggggaggggcuugauggucagcuagucuagagcagaugcugucucaaaaucuguaaaagccauggagaaagaauccagacauugaccucugcccauacacacgcacaggcauacaagucaacaaauaugagugccccuacauacacacacacacacacacacacacacacacggggacgggggagaagggggaggaggagagaaaggugggggggagagagggagggagaggaaugcuuauaaauuaauaagaaguauuauuucagauaggaaauaggcaauaaaucacaggaauaaagacaugaaagcaugcacguacaaagacuuauucgguauuggcugaucaaauaucuuugccaaucagaaggccacggccacaucugcguuagaaaggcgcaugggaaccuucaaugucacuugcauucccuuuuaaguucuuccgacuucccccuacaguauguauauucuacuuuuauagccauaaagcaaagguaaaucuuuucucuuuaaauuacuugcuauucuuuucagaauuuaugucaccucugguucaagauuacaugcacucaagcacacgcuauuaaaaucucauacuguuaaccaggaccuaacagauucgggacccagaacugugguaagggguuuguuuuguuuuguuguuuguaauguuugguuguacaaucacuaauuucuucccuguaguucuuugugaaacauuugucacuuaaagaugcaagcuggguggcaaucuuagccuuggggagauagaaacaggagggucacaaguucagggccauccucagcuucaugguuaauuagaggccagccugggcuacauuaacccugucuuaaauccaccccucaaaacagaacacacaucucauaccgcguuauuuuuauuacauuguauaauuuaaaauucugaaacagagcaagauccccucccgcagcccccagcccuucugugguagcaugguaaggagggacaaaggcauuuucucaucucuccucaguucgaucucagucaucuacauagcagaaaguccauaaucagaaaacuguuagacauaggacguaugcaguaauaugcauguaagcagcccaugugccuguauuuaccucccagacagagauuauuuuacccucaggcaaagcaaacaaauaacccccucccagaagaauacaaacagaaaacauauucagacaugguggucaagggcagaacacacaugguccucuccuagauccacugcacagcagauaaaagcagggagucuggacacacugagugacauaucugggaaacgggaugaggagccuggcagugucccuaaacaccacaagucuauuuaaaagggaagucaacacaggcaaggugauagcugaaaaccgagaugagaaaggguuugcccacaauaugaacagaucugguguuuugguuuuauuguuaagguuuuguuuucuaguuguguguguauguaugugcacacauguguaugcacgugugaguguccacacgggccagcagaggacauuagauccucuggaacaggagacacagauaguuaugagccagcugacauggacgauggucaccaagcucugggcuucuacaacaguagaaaguacucuuaacagcugccccaccucuccagccccucgcuuuuuuguuuuuuaaagaccuuaacuucuaaaguaguaagaaaccacuuccaagcccaacauacuuuucccuaugaagccuuaaaacagucuaugcaaaucaaagcauucacaccuggcccuuuucauucauacuuuauuuacaauuugacaaggagaguccugggagagcacuaagccuuugccacgagaacaaagcuaggcugcgaaaauauaaacuuuagaugccaaaggucacacagagucaaucugaaggcucuucuuugauuacgcuauuuuuuccucaccacacaggugcccuuaaccccucaugaagacgcccauuauacaaaagagagaagcuaagcuggggaagguagcggauucuggagguccuugucauaacuuauacacacagcagcagguaagccucaaaaugucaccaaguguucuagagcugcuugcucccccugaaaagugggaacgggaacgaggaaccagcaggcgacuucagugcugagcacagacgggagacuaaagcguaucuuuugacaggaccuuaagaaaacuaaaagcuuugcccuccaucagccucccccgaccucugggacggggucagguccuccauguuaggcaauaaucacauucuccugccggcaaggcuucuagaguuauguuuaguuaggcacuguugucucaagugcuagcaaaguaucuguguggaugaauaagugaauaaaaaguuuuaagauauaaggggguggagacauugugguacaaacaaccagugugcuacauguagugguuauuaauaaaaauguauacaucgauucagauuuuauuaaugagguguucacacuguagauuugacucauaaagcaugaagaaaaaaaaaaaaaggcagaauaccaaaacuguaaagcaaaacacggcagaaacaagaaagcucgaggaagggcaggagccgcacgaggcucuauaaauaucuuccaccacaggugcgugccagggcucugaaagggaucacagccauuuguccuaacuuacucugagauugucauaaaacaccagacaggagggcaaggccaauaaacgcagagagcugauuucuugaagagcaacucuuaaauaauuucaaacaaaauaauauauguaaagaagaaauccacacugagguggucguccaacuccagauugacuuggcggcaaaucccuguguguuaucugcuccguuuaccucaugagccccacacgcuaccuaagcacccaccaaggauggcccgccaauucucgucuugcgucugccuccccuaagagcacccacuggaucuccacccagaaaucaagcucgccugaggucagaugggcaacccugcccaagucuuuauuuuaaaaacuucauccccaggcuagggcuaccaggagguggugaauuuuuuuuuauuuaauugguuuaggcuaggaaguauaugaauagaauaauacucucuauucaauuauuuuuuuccucagccacuuucaaugucccaaaguuuaauuaacagaacagagaaggugcccugaacugaacucaacagucucuguguguaugugugugugugugugugugugugugugugcacgcaaucuuuagggaguggaaccuaaggagacaugguguagugugaaugaaagacagaaaaaauuccccauagucuuggccauuugaauccuuggugccugguuggugacacuguuuggggagaucuaaaaaucauggccuugcuggaggaaguaugucacuaugucacacuuugaggauucaaagcuugcuaucauuuccagugagggugccucucccucucucucucucucucucauaucaugaucuccuucauguuccugcuuccaugccugccccugaccaacucuuacuccucuagaaccagaagccaaaauaaacucauucuauacauugucccaaucauaaguguuuaucacaauaacagagaagcagugcauacagacaucaugaacucaccucagaaaugcucaaagggcuaguaggacccuaucucuuucuguuugccuuugccuccuggcucaugagauggguagauuacucugcaagagaccccagccaaccauguugccaggggcccaaagcgauguaucguugcauucuacaucagacccuccaaaaugaugagccuaauuuaguuaaccuuuuaucuuuauaaauugguuaucucaaguguuucauuauaguaaugcgaauuaagcuaacagaaccucagucuuccuuauucccugccuaucgcucacaguacuuacccaauacuugucugacaccacccacucacugcuucaggcacuucaugcuucuacucucacccaagaaaaggccgaggcacagagaggucaucuccaagguguguuaggaguggcugagucuaucuauggaggguccuugacucacaguggguccacaaucacaucugcugagcccugugguuggugcucaugcaaaacggcuuccuucagcuuccagggcuuccuguccuccuccacugccucgccugugcccacccuuccguuccauuccuuacccaaggccuggcucucauaaugugcaauagccauccucucucucaggacagggauucuguucccuccuugcuuggcuuaguaccugagugucuucuauuugcuaccaggccuaucauaaaagcagccagguaaguacaggacagacucaacuucccggcacucugccaauccauuaaccugccugcaagaaagagcccagcuaccuguacugcaugcagaucucuccaacagggugggucauucuccaagagguucucuccuuuguggucuauuccuguuugcaaugacugacuuugggauguuggucagaagucauuaagcaguugccuggccagaguaaagcucuggguccuaccaccaccaccaccaccaccaccaccaccaccaccaaaugaacaaagaacugguuuugucuggcaaaagcuagaagugcaaagcgugugguugaaacucacuuuguaauuacuuaacacccauaagaacuuuugguaaaggugccuucucucuucagacaccucccuccccaacagagacacucuccugagccaaugaaaggcaagcaggagccaggcagugguggcacacgccuuuaaucccaacacucgggaagcagaaacagacggauuucugaguucgaggccagccuggccuacagagugaguuccaagacagucaggacuauacagagaaacccugucuugaagaaccaaaaaaaaaaaaaaaaaaaaaaaaaaagaaaaaagaaaagaaaagaaaagaaaagaaaagaaaagaaaagaaaagaaaggcaagcaagcaggagcugccuuucugcaagccauagagaggcccaccaccugucagagggcaugcaguuaauugggugacacuugugaaggggauuugcgacccguagcacauaugucaucccggaucucgcacauggcgccccacacugcaaaauccaagagcuauuuuuaaaaucuuccaguugagcagaacuuacaugucuccugccgugcgcugugaauucauuacuuguccacugagagagaguaccucagaaagugucacgaguguggggcagugcuggauauuuaccuccccccccgccucccccccccaaaaaaaaauacaauuccugaauuugcacuccauaccaaguuuggagggaacccaugaagugcuugcugugugucauguauucuuuugaaaacaacaaucccaggggaaauaagggaagaugcuauggaugucacuuacacacaaguccgugacucccaacacuuguggcaaucccaggacaugcucaagcggcuucggggauggcucacgcaagaacaaaagcagcuucccgacagccuggcuguacucgcuggggcgguuaggccaaguggcucuguggguguggguuuagaugugguaucacguuuuuuccuaaauuaaccauaauuacgcaaaagcucuucuggcuucgggaaaaaucaaggguuuauuuuuaauuaacaaggguaggucccuaauucccucuuucaaagugcuuccuuuugcuaaaggggauccuaugaauuaguggggagguuuaaugaauugccucuggcuaagaggcuugagaguagucccccucagagugacauuugcccaaugacagaacuauugaaagcugcccccauucuaccuggcuucuccuauaacacagccacaugcucugggaccucugcccuacuggcccucugaugacuaccacugugguucuguuuuuguuuuguguuuuguuuugccaaacccuuuuggauuuaucuuuuacaggcucaugucucagacagcacuucgaccauaggaaguucccacucaaagcugaguuauaacucaccuugaacucaacuguuuuuggaaacaguuuugugugguauuuaauuaauauaacuccuucaaguuuugcuuuuuggcucuuguuuucaaacucagacaaugugacaaaauguuggggacccuuuggaguaaagccuguguugagggacugucaaaaaaugucagacccguuccuagugcuugcagagagaaggaaagauauauaagagcaagugcccaggguccucuagagcaguguuuuucuacccaaggaccccuaggcguugaacaacccauucauggagguugcagaagaccaucagaaaacacccacauuugcauuaggauucauaacaguagcaaaauuaguuaugaaggaguaaugaaaauaauuuuaugguugggagucaccacaacaugaggacuugauguguauuaaagggucgcaacuuuacgaagguugagaauaaccuagacuaccuagacacaugugacuauuacuggcuaauaccaauaucuaaauucuucagcuaccaaacacacacuaguagcaucacuaagaauucugaagucauuuaccacuggaagcccuacauagcugucaccagaaaaguaaggaaucacgggcauggagagaugucuuggcacuuaaaaguacuaagugcucucccauugacccaaguuuggcucccagcucacaauggcauauaacuccaguuccaggggaccugaugcauuuuuucugacaucugcaggcucaugcagacauguugaacauguacaaacacucaguacaugugcgugcacacacacacacacacacacacacacacacacacacacacacacuuaaaaguaaauaaaucuuugaaaacaguucgcaagcuggguacaguggcaugugucuguagucccagaaauguggcagucugagaagggagcacugguugagcugaguucaaagcugagcugggaagaucaucaccgaccaccucauccaacuuacucuuuauuaaagcgauagugcuacauccacugaauaagcaccaccagccacugugcuugguagagccuuacagagaugccuucaguucuugcaacgguuaauaccgauugucaacuugacaggacuuagaacccguggagacgggucacuaaguguaucuggagagauuauuaaguuagugaggaucaccucaaaugugggcaacgggcaucccaugaguugggguccuggauugacuaagaaggggacaucuaggugggcaccagcauucaucucucugucuccuggcucuggaugcaauaugaccagccaccucagccgccuagugucaucccuucccaaccacaaaggacuacauccucucacacuguaggcaaauuaacccccuccugcccugagugauuuucaucagauauuuuauaucaacaaauguaccacugcaccacuaaucacagggaaugauggcuccugggagcaugcacuuaaccugccacacugcaacaggccagguccacggccagugcugggcacacaagaaguacuuaacaaguaugugguggguaagauuuuaaaaggucauuucucauaauuaccacuauuaucguuauguuuuccuccucuuccuccucuucccccuccuccucuucuuccucuucuuucccuaccuuugagagagagucccaauauguagcccaggcuaauaucaaauuuguaaacuuccagucucagccucuccacugcugagauuagagcucaaguuuggggcuagccugggcuaaacaguaagcuccuaucucacaauaaacaaaacaaaguuaacaaaacagcuccauguuuuacuggaguuauaagaaaucgccauuucuggguucacaggcuaaauguuuuccucccgucucuaauuuucaucaggaaaaccagagcgauauucugacacacugagcuacuuccuuuaaaaauucggccuuaucuuuucuucaauaguaauaauccuccuguaauuaacgccuuaaaucuguuguggggaggaucuuugcucugagaacucauuaguaacugaaguagccaugguacaagcgccacauuucaaagccaaacaccacaugcuuccucgugucuuucuauaucaguacucaggaaacuucucuuuuguucuuggaagcauucagagcagcugugauguccugaagaauucuuacuucaagauauuagcaugugccaggcacuguggugcaggcuagaauccuagcccuagagaggagaaggcaggaagugaaguguuuggccacauaauagaaugaggucagccuaggaugcagggaagccugcccaagaaaggaggaggaggaggaggaggaggaggaggaagaggaggagcaggaggagcaggaggaggaggagcaggaggagcaggaggagcaggaggaggaggaggaggaggaggagaaggaggaggaggaggaggagcaggaggaggaggagcaggaggaggaggaggagcaggaggagaaggaggagcaggaggagaaggaggaggaggagcaggaggagcaggaggaggaggaggagcaggaggaggaggagcaggaggaggaggaggaggagcaggaggaggagcaggaggaggaggaggaggaagaggaggagaugacuaaaaagucaaagggcauuauuuuuauuauuaacuuacuggcuuuguuuuguuuguuuagagacauggucucucucuauagucuugaaacucacuauguagaccagguuggcuuugaacucagagagauccuccugccugugcuucucaaguucugggguuaaaggcaugggccugccugccugccugccugccugccugccugccugccugccugccugccugccugccugccugccugccugccugccugccugccucccucccucccucccucccucccucccuccuuccuucuuguguuugggacaguuucucuauacauagcccuagccauucugaaacacucuaaguaggucaggcuauucuugaacucacagaaauccaccugcuucuaucucccaagugcugggguuuaaggcaugcucuacuguacccagauaaaagggaacuauuuuuauuccaugcauucuaauacauagguuaaguauucaauuaauguugaguggaugcgauugcauaacauuaaauuccaaaaaucuggguucuuuguguaggaaaaacuuuccuauuacauuucucauagucucacagucagugcucaaucaauauuuggugacugacugaauggcaggacaaugcccuuggauaagauugguuggacugguuaaaugagauaauacugacccaggacuccgccauccucaugacugcccacagguucaugaguagagccuucagcgcacccucaggguagcuuguggcacuugggccugcuuguuagugaggcccucuuuaugacccaccuuuggcagaaaccuucugaagccaugugguugcugcuugccaccuuauaaaagguggcuucguguaauguggcuuguuacuuuaagugcaaccuuauaauuaaggcuacccuagagacaaaaauguaauguugguaauuaugguuccuuggcuuuauaggaagggaaaugaccccugcaucaagaggccccacucugacagcuuuaagaccaucugcucuagauuuuccauccucugucaccauuugggcuuguuaaaugugggaaauguggguauggcuuccuuuuuuuuuuuuugcuuauaaacaaauguauguguacuucaguacuucaacggcuccuuacagugggcguguccaaggacugcucuacaagacacuuucaaaaauucacuguccuaaguguguuuacagccacacaaguggcaugugucugugugucaaggaaagaguguucccuugccguacguacgugaggaaaacaacuugcagagcgaccaggcugucaucugacggaugccgcuugauggccuccagcaguucaacuuuauuacagacacaaggaaauccuagguuguuuggcuguaaauacgacugcagucuucagggacaauguugaagucacucaguuaaaaauccuuaccaaauccaucagugucaaaauagcuuucucucuucaguaauaauggcaucuugucagcauuccauuuuaaagaaagcaaaacugagggggcuggagagauggcucaagcaguuaagagcacugacuguucuucuagagguguugaguucaaaucccagcaaccacaugguggcucacaaccaucuguaauuggaucugaugcccucuucugcugugucugaaguagcuacaguguacugacauauaauaaauaaaucuuaaaaaaacaaaaccaaaaacugaacuucaauagucugucauaaaaguucuaagcucaguauuacuauccgcagaacaccucuggguacgacucucuauaauggguauugcugaauuacugaaaaguagaagucuacuuuugacacaggggacugugacacauguucugaaaacacauggcuguggcuuuaacacuagccauaccgggguuuauaaugugagaagaaaauaaauaguaaauaagaauguacaagacagaagagcagacagcacacagacauucagaaacaaauauuucucuucuccuggagaaagcagcgagggccgggagaggaagucgcauuagagcagcagaauaagaagacaggaaugaucaauggugacccacagauggcaggaagaaggaauucuuuaaaacaaaucacggggaagauggcucaguugguaaagugcuugccacguaguauaaaggucuggguucaaauucucaggacucaucuaaagccauuguggcgguaaacaucugugacccaagugcucuggugggggaaggggagugagaagauccccaaaagcuccugggccaguucaucuggcauacaaagugggguauaacaaugacguucucuuucaaaagaggugggaggcaaggagauucguguccuugguuguccucugaccuccauuacagguacauuccuuugcuugucuacugcuaugauaaaacuccaugacaaaaagccaacuugaggaggaaaagguuuauguagcuuacauauccuggaucacagucuaugaagaaagccagugcaaaaaacaaaacaaaacaaaacaaaacugggcagaaccuggaggcagcagcugaugcagaggccauggaagggugcugcugaugggcuugcucccugggugcuuauucaucccgcuuucucacagaacccaggaccaucagccacaguggacuggauccucuacaucaaacacuaauuaagaaacacgccaccaggugggucugucuacagcccaaucccguggagguauuuuuaguggagauucccuccucgcagaugacuuuagcuugugccaaguuagcauaaaacacacacacucuacagacauguuaccauauucaugaaugcaugcacacacuugugcaugcauguacacacgcaugacagacacaaucucuuuaaaauaucuugacaacagaaccuaagggagaaccucacacccuaugcuuagagguugaacaaggccuaacuaagagcugaaaguagcaaguucuuaaagacagcacagagagggcaaugauuuuugagguauaacaccaaaaaaaccgcaggcaaggaaaaaaaaaaaaaaagauuaacuggacuucaucacaauuauaaaaucuugugccucuaaugaggcaggcugacuccaugacaggcuucacauuggcagucaggagacuaggccugaauccauuuccaagaacugggcaaguccaggcaaguccaggccucagaagcugcgccaccucauggccugaggcaaggacaaugggucagcagcaguuuccagacuucccaagcuaugguucuagacugucucuagagauaaagccagugacagaggucaccuaccccuccccagaauucccccaauggguuuuaaaucaggccugcgagcucacuuuggaguccccaucuuggaauggaagaccccagcaugccagacuucugcagaauaaaacacucuuugcuuuuacauacuauuugagucugggauaucauucuucugccaaucauggacccuuacaccucaaaggaugcuaucaagcauagagaaugacaaccugugacagaagaaaaugugugcaaaucacagaacugaugauguaggauuaauauccacacuauauaaagaaugcccacaacccaacaacaaaaauaaccaaccuacuucccaaaggggaaaagcacaaaaacacagguguagauaucuuuccaaagaagauauauuggggguggggggaagacacacaacauccaaagauacugauccuuaguaaaaugcaaaucugaaagagcaugagaugccaccugugcugguugccaugacaguauuuacaaaccaagcagaaaguaaguguugcuggagagaaacgggaaugucugugcucugccggcaagauccaaaauaaggaacacaggagaaauuccugaaaauggagagcagucuaauucuaugugaucaaacaguccaccuccaaagaguacaaagauguaauuuaauuaaaaaaagccauucuggguauguucccuccaaagaaagggaugcaggaacucagauguauacaccccaucacagccaaaugucaagaaacaaguggguaaaacacagggugugaacacaauagaauuauucaauauuguucgaucuuaaaagagagacugugggcugacuagauggcucagagggagaagcacguuccaugcagcccuugacaacccgagucaucauggcggaaggagagaacggagugcacagaguuguccuccaacucauggacauguacccacagacauaaaaccacaaaugauacugaguuuuaauguguguguggacauagggagugguaugugcaggggccaccagaguccagaagagggagcccuaucugcuggcuaaagagacagcagagaaaagcucuucaaacagaaguuccucaaaaaggcaagcaauguaauucuaaucgaucuggcuggcgggaacccagcucucgcacacucguagccacugcgcuaucucuuuggcccgcuaaaacuaaaauacuauuucaagaugguacuugugacagguaacggagcauggaugaacacagaagaccuuaagcuaagugaaacaagccagcgggggagggaggaugaauacuguagccucucacuuggauguggagucuggaguaacagaagucagaggcaggagggcgggaguaggcugccaggagguugcuaugaaggaggacauggcuuccguucugaaguggggaagaaaaggguucugaagauggcggcgagggggggguguuuguacagugaugggaagaauacauuuaaaacggagaugauagccagguuugguggugcuugccuuuaaucccagcauguguguggggggggggggguggggcagaggcagguggaugucuugugaauuugaggacagucuggccuacaaaucgaauguaggauagccagggcugguugcacuaagaaacccugucugggaaaaaaaaaaucaaucgauaaauuagugaauaagugaaugaaugaaugaauaaaugaaauggagaugauaagguaggagaccaucuuaguggcaugguguuugucuaucuuacccaaagcccuagauuugguuucuaguuggggggaggaggcggggagcacacagcggcagugagaaaaagagauaaaccucacccaaaagaaauuccucuccccuuuccaucuggucaaugccuucaacccugcuggucccuccagaacauuccugagcucagaggccugcccuaccacucucuuccuuacaucuaagccaucucucucaguauccaccaagaccuagaaaguagcaaucuguccuccuugggcaaaguaggaccauuccgaaucugucuucgagaauuacaacagcacucagcaaauaccaaacaaccucuuucuuaucucuuguggcucagaagcagguuuuccuccuauggguaugguucacacugggucucuuaauaaagucuuucaggagcgcucucugaagccaaaacaaaguggaaaagcaagcacggugcucaacaaacaagucggaggaaaagggcggcacuuccaccucuuugcagcaaaccaggugacaggcacccagcaccgaaaggaaaggagugaccaccuagagugaccuacaguccugccccuuuugacucugucccuuguccaucaaaggauacaugguccuaaggucuuucuuuuucagagaaaaaaauauccccaaggugccccaugaaagcuuuuuugaagcucaaaaccagaugggaauagaaagaguacauuguugcugucugguuucuuuuuccuuaguuuucguuuacacauugagcaaaguuagcaaaaguaacagucacaaugccaggcuaaaccacaaaaccgagucugucucaggcuaugcuggauaggggacuuggccaccaaguagagcaaguuucuauggugagauggaguauggaaccugcgugaaaugcaaaaaaugcacaagcuuccggggugguuggggccagccggacaacuggagccaaaacugggggcuguuugugcuugacuccuggaggagaagacagaggagucgcuagauagagaagcagcugguaggauggaggaaugaaccccgagugggugaggaugaagaguuguaggcaagaguaagcaagagcugugcugagagggaaagggugccaacggcaggcagcggcuccuaagcaucucucucaaccagucugcacccacauggaguagacccccagaaauagagcagaaccucucaccugccagccugcucaaccuacuuucaucauaggagguugaggggaggagcaaaggagcuucagcccucuauucucugcuccccuuucuuccuccuccucuucucuuaagaauaguaucaguaucugcucauacucccacgcacgcacgcacgcacgcaccccacgagcucucccugccuagggcgagcggucagagaacgcacaggaagcuggaaggcaccugguaggcagugggaagugggcuuaugagcagaauccaguucuccuuggucagaaagagcuacaggugauuccccaauccgagcagcuuccaacacaggauuaguuuaucaucucugccacucacucuccagccaugcacucgcuggguuaaaccaaaagcuucggcugcugccccuggcgcgcucaccauuggacagacgggauuugaauggggacagagugcuugccuagcagcaugcaccaaguccugggcuccaucugcaguacaccuccucaccccggccaaaacuaacaggaagaaggcaggcacauagaaagagcaucaaaaauggguuugggacuauggugaauuacucuccuagauuuuaguucuuacagguuuuguucucacugaauucuggacuuacacacuuugauaacuauuauaagacaacagccagccgggcggugguggagcacgccuuuaaucccagcacucgagaggcagaggcaggcggauuucugaguucgaggccagccuggucuacaaagugagucccaggacagccagggcuacacagaggaacccugucucgacgaaaaaaaaaaaaaaaaaaaaaaagacaacagccuaucucuagaaccacauuaaaaaauagguuuauagaagggacccuuaaagcaugaaagagcuuuuuauuaccuaauauacuuuaauugggagcccuuccuccucuaauuagacgugugaaccucaucacacuuuacauuuuuauucgccagaaggcucggagguaauacuggcacuuccuucuuggaagcauuaauucuaaaaaucucucuggcuuuaaaauuaguuuuucuuaugucuuuuuuuuuuuuuuaacaacagaauaauagaaaacuuuguugauugcaaaaucuaaauagcucucaaugcacaaccacagagauucauuuguucaacaaacacuuauuggucauaauacauucucugccaagacuuguucuacucuuggagauacaguaauagacaauauacuuaguguacgguccccacaaaaaggugagaaaccgaacucaagguuuuaaguuugggaauuagcaagaaagguuguacaaucuuauggaaauacugcaaaccacugaauuacauuuuaggaaguaaauuuuacggguuguaccugugaaaguuuggcaggcggcgugugauguuuugacauggcugaugucuauccaguaaaugucuucuaaagggcaggaucagagccacacugugaagugcaggcauaaugccagcacuugagaaucugaagaaggacaauccagaguauauagcccgagcuauauaugcacggaguucaaggcugccuggggcuauacagugagucauugucucaaucaauuagcugaucaauugaucagcuagagcauuuaauaaaaagauaccuaccuaaacagaggugaaugucuacauauagagccuuaauuagaauuagagcuggcauuaaugcucugccacuguguuuuugaauccagcccugucccaugaauucagcuuagcuguucccauuaguugguccaguuuacuggacugcauggcugagaaaugauacaagcugucuccauccuuaaagccuaucuauacacugcagagucccagccuuagggaugaacccuaaccccaacccugcucucccaggccacucccagcagaccguuccuuucaguggcaugaugacuuucacuucugucccguugcucuagggcuucaacucaucuccgugagaacaggcgagaacgagaggcuagaguuggcuguacacagaucccugucaccacuaccagugugacagaccagaucuuuaucugugaguaucuaguccuuguaacacaaccugccugacacacggcagugcuuccugucuuaacagcaaguucuuugugauaccaaguuacaaaaacacacaagaacucuacgaaguauuugguuuccuuuuguccuguuaccguuucccaacacuuauucuccaguaaaccauggcacuccaucauuuagcagucaauacaagaguuuuuacacaauacacgaaaaaucacaacaugaggcaagggggacagagcaucuauaaaaugccauaaaaaaucugucacuuugccugcccaucaauauacauaauuuuuuaguuaaaauaguaugggacuugagggcugaaagaugacucagugguuaagagcacuaucugcucuuccagaggcccugaguucaauucccagcaaccacauaguggcucaaaaccaucuauacugggaucugaugcccucuucuggcauguagguguacauacaaauagaguacucauacauaaaauaaauaaaucuaaaagaaaaauauuaugggacuuuguagaaucggguugccuuauuaaauaaacuuuguuuguuuguuuguuuguuuguuuguuuaaaaagcagcuuacagggccagcaauauggcucagccgguaauggagcuugccaccaagccugaccaccugaguuggaucccuagaacccaugcugggaggagaaccaaaaccuugcaaguuaaccuuuaaguuccaccugcauguaugcucgccugccuacaugagucucucucucucucucucucucucucucucucucucucucuuuuucucucagaaggggggagggaggggagagaagggaggagaaaaguagagaggauaaacaaauggagaaagagaagaaaaacauuuuaaaaauaaaaaagcuacagguaaaaacggaaauaucuuuaucuuauuucaacuucucaauggaauuuuuaugaagucuuuucuguuguguucuaaaaggauauagagauuauaaaccagacacaguuauagugcagguauccaggcauguugugugucaacuuucacaaguuagaguugucugaaagggaaacucagcugagaagaugccuccauaagauccaucuguaaggcauuuucuucauuugugauugacagaggaaggcccagcccacuguggguggugccaucccugggcugguaguccuaaguucuauagaaagcaggcugagcuaccuagagggaaggagcaagccaguaaagugcaccccuccguggucucugcaucggcuccugccuuuaguuccugcccuuuuugaguucuugcccuaaauuccugugaugaucaacugugaugucccuucacaaguugcuuuuugguuaugguguuucauuacagcaauagaaauccuaagacagcaugucuauaaauucuaacugcccaggacaccaaaguaggauuaccaaaucaaggccagccugggcugagaauauaacuaacccuaucggaggaggagggggagggggagggggaagaggaggaggagggggagggggaagaggaggaggaggaagaggaagaggaagaggaggaagaggaagaggaggaagaagaggguauggagaaggaggagaaagagaagaaggaagaggaaggaggaacaagaggaagaagaggagaaagaggagagaggaggagaagaaggaaaagaagaggagaaggaaguggaggaggagcuaguaagacaacugaguggguaaggagccaccaagccggacaacacaagucagucccuggaaccaacauagaagcaaagaagugaucccuguaagcugcucccugcacagcacacagcacacacacacacacacacacacacacacacacacacacacacacacagaguuagugaagguauucacaaaggucuauccuggggaacacaguggauugggcaaugcccgggauuagauuaucucccuuucuggaucacuagguuuugccccuguccuguggauuacauacagcuguucauauccacccccagcucacuaagagaacucaauaagggaagagacauggaagccuuaccaagccuaaugcgcuuuuuaaaaugucacuucgguaauuaucagcauggcaguuaguauagccuccuccacuccaguucccugcagcaaauaaaaugcccugaggcugagacacgcagagaauccuaaggaugcagaauguaucacuagguaauuauaacaucacugacauguaaaaaauucaucaaaaacauuaaauaguaaaauuucucuuaaguuauaaagaaagauuuaaucuccacaagccaagugccugccuccaacuaagcauucagauaaaguauagaaauggacagagauagagaucaaaggaauagcuuagagaagagaagcccagaaccaaggagaaagggcaaacacaaacaaauacacccuuugaaaucacagauggaaauccgacuuccucugggcaucuuuguuaagagagcccccgcacauauuagaaaaauaacucucacccccacaaacaaauccagauguucacgaauauucaugacgugcuuccaauuuggucuggacuuguccuugauuuauuuuugauuaaguuccucuggcuucuggcggaucucugagauaaauggcggggcuguggcacaaauuuagagcaucuucauauuuuaaguaauugcagaaagucucucaaacuaccccuuauaaaugaauaauuuauucacaggcuguggaaugccaaggauagaauccugacucugaacucuaauuuuacugcuaaagguauuaaauuaaaucuccacuuguaauauagggccugacauuuagggacagaucaaggaggcggggauguuucuuugaugagugaugcagggcauaguaaagaaaagguaagacucgagggguaaagcucugugaggcguugguaggaugggggauggaguguugucccugaaauacaccacauuagcauauaguuucuucuuaccagauaccacauacaugguugaaaagcagacccaaccaaugacacaaaacgaacuucaucaacacuucacuaucuugcuuuccucuucuuaaagcugguuguagaggugcaugucucuaaccccagcauucaggacgcucaaaacuucaaagguagccugcaaauaccaagccagucaaagcuacguagaaagacccugucucaaaaggccuaaguggaugaaugcauaaauaaauucaaaccuugaaacuuccaaacuaaaugaaaaagaccaacugcaaaucaaaacacccugccgaaauggguacaguaaucugaaaagagguuuucgaaacauggccaaccaaaaaccaaaguaugugcuaaugaggcuaagcagugucucacugaaauagcauuugcaagggacauacaaggcuugagguuaaaaccccacccagcauauaaaugauuaauaaauuaaugcauagguagguguguguguguguguguguguguguaugugugugcgauucagaccugggacaaacaguugaggugcauauuuaacauaccaaaguggaccuggccuccagguccucccagcaucccucagucccuagcuggcacacaggcagggccucuacccugaacuuuccagcccaggggcugggcuuccccuccacaagaagcuauuuuucuguguaauccagacguuuuggggcuuucucucucccugugugagcuuuuccucucuuucucuucccccucgacucugucucccugcccacagugacuucccuggccugguuccuugggaccagugaacccaccugagaguggcuucccaauaaaccugccuuuauauauccuaaucuggcuugaacuggcucauuucaugaguggagaauaauuuaucuuuuuuuuuuuuuccugccagagcugagggaggacaucagucuaaaauguggaucuguggaccaaagaagucgaggacagcuaugauauccucugcaaagcucacagcccagccccaggugaccagcaagcuagauucucuauagaccugucugugcccccacuccagauacuaacuuuccccaugcuccaagcgagacccuggaagagaggugggcuacuaucaugucuaugccauaguucucacaucugaccucagacugucucaucaaauggucucauccaaugacaucacagacauagcuuggaaacuccuccuuuugacugccuaaacgcgcacacacacacacacacacacacauucaccgccgugacaaauuaucugagaaaacaacuuugaaaaaacaagaagaaaagacaaauuuuggcucacaguuugagaggccacgauggcuccacucucuacugcuucaggaccugcuauaaauggugagccugcuccacacugcagggcacaugugacaggcaugaugacagaaggcaaagagcagaacaaggaagggaacagcuuuugcucuucuaagccacaaaccccagaaacccaccuccuccaacaggucccaccucgagucgucccccccccaaaccccaaaagugucuauaaauuaugacuucaucaacuggucccuuccaaacgccccaccccuuuacagccaagccaguuaagaagaagcccucgggaccacacucauuccuucaaauuguguuucauuccgagaccaaacuaccucuagaggguuacaaauuaaacuuuuuuuuuuuaauagccuguaauuagcucauuauuagcacuguaaucuuccauguuuuuuuaaaguguuuaauaaauguaaaccuuuagaucacacuacaauuuugcccaguugguuuuaauaguccaggguuccaaaagaaacacuagccuggccuuuacuggaaaggacaggcaauaucgccacgugccuccugccccagggaagugagugcucauuuauuuauccacagaucuuucccuugaguuucuaggcuuuucucuccccagcugaugugaauuuuauuagcauucgggaagucucucagaccuacauaaguagaaacaacaaauuguuccccuuuugacauuuguucacacuuaaauauuuuuauucucucucucucucucucucucucucucucucucucucucucucucucucucucccucugugugugugugugugugugugugugugugugugugugugugugccgugcacauggggaacgggcagagucucagguagcuaguuuccuauguuguuuauuuuugaggcagggucucucacugaaccugaagcucaccgacuggcuagagcaacuggcuagugggcuccagggaugcacuugucuucaacaacugccagcaucaggauuguagacagacacaaagcacaauugcagcuuucacaugaaccccgggggucugaaccgaggccauccugcuugagaggcaggcacaguauaggcuacugagucaucuccucagccggguguuuauauuuuaaacagaagacaguucagggccuucuguucuuggugucuuuuaucaacucaaacuaaaaccggucacuucugaucacuugugagcaaaacgacgaggcugcugagguauuuuugaaaacucugcaggccucacaccacacacaggugucugugacugcacaagcaaagaccaccaaggaaaagacagaagcccgcaaaugcauuguuggaauggcaaagcccuucucguuaaagcagaggugccguaggccaagaucaaacccagcaccaagagaucuguuuacggugacauucgugccgugcaaugcacaaaaacugcugacaaaauugggaccugccaugggaacacaaaugugacuuugucugagaggagccagagcagggggcaguguuaccaucuggcuuaagauauaaauaaugccucaguguguuuugacaucgagugugcgaaucccccagcagaacggacuucagacuccagucuccggcccacggauuccgauugcaaucugcuagucaacaguggcccagagcuagggaauaauggaagcuaacacaaggcaaaacaacaaaacaaacgcccuucagagcagccagcuucagagggcgggggcuccagaggagucauucaggaguguguaacaagguugucggaguuuugucugaugaaaaccagaacaggaacaguaaagauucagaggucccucauucucaguucugcaagccuucccuagcgauacugggacccugcagauuaaccuagaugacuucacuuucucuauacuuucuagaauauucagaagccacggugugcagaaacuaugcuuuccacgggcuuugcugucuguauagaagaacgaucaaaaaccauaacaaaaagucccacagaggggucugugugaagcuaugccaaacaagaacaaguucauccuugugagcgcccgacuugccagcaagaacgaugccacaauaggaucugcacacguuuaagagaccccaagcccagaacuggugcugcuuauauaggccuaggagaggugugucucacacccggauugguuaugcauggguuaugcuuaccaccucauuugcaugccuacaucugauugguuaacuugucucucaucugauugguuaacucucaaaaccucaucucggcaaaaaaacuuuacugccuauguaugcgugguggccaacgguaaccagcaccacccugcaacgggcacauguggcuucccacacauccuggcccgguuggucaaugggggucaaaagagaaaaacgguuguuuuucauugccuaacagacaaaucagaagagcaucugcucaaucucuuucuguauuugauaacccaaggucccacgaagagcaucacaacccuguccccauaucagucaguccuugcuuuccacuaccgggaauauucaugcucuucaauggacucucagcuuuuggccuucacccaaacuaugaccuugaccucuaccucggguuauuuaacauuaugcucaccuccuauguuuaaaaaaaagaagccucccaaguucuuuguacuugggaagcccaggcgucacuuccacgcugcuuccaaacuucccuccugagccagcgaccucgucugcauuucugucaccuccaaacugucuguuagcgucuccugugccuagcacgcucugagcucuuauuuggguagagagaauaucuuuacuuggcaucucuggaagcacucaaaugccaaccaaguguaggcucuaugcucacuaaauauuuucaauugauuccauacauaaacaaucucaaaaaugggaaucaggauguguguguguguguguguguguguguguucacuuagagaacugagugugggcuugcauuuugccuuaaaagagucauaccagcacugucagaggagggaguaaagacgagaucaguguacaggaugcuggaagggccaaggaugggugucaugcacaggaaacucauugucauuacuguuuauguguguuugaaauuucccccaaacaaaaagcuaaaaucccacaugauauuaaugaagugucaauaauggaaacucuuccccacuccugcaggcauguuugaacuuggacgaggaagaaggaaaagaaacaaacaguuccaagucacugagggugaccuccagcuuguuucccuuacuccucuuaacuaggagacagcuauagagagggaaucugaggcuuggugaugagaaagugaagcagacagaauuuaaaccuggguucaacuccccaguccuccugccucaacuuccuaagugcuaggacuacagauguauaccaccagauuugcuuuuauugcuguuauauuacuuaagaguuguauuugggaagaugaucuuacuacaacuuaaccuuaaaaaaaaaaaaaugaaauuauucaacgccagaaauagcaacuauaaccgagaagcauuccacacaucgagaccaguggcucugaugcuccccuguaccagugcucuaucauuacuuauguuucuacucuccaaagaucuggggaagucucuaccuggcuccuuucuuguguacacacaucaccaugauaacaaucuggcagaaucuccaggccaggcuuuagcuaccaacaaacaccaucaacugcaggucagcacagguggagacuccuguaucagcucuauacccuaucaaggaccacacaaacuugucuucugcaaaaauccaaacugucuaaaccucaaagacaccaaggaagcugaugcugccaguaauaagaggccgcugccaccaccgccgaugccgccgaugccaccgacgccucgagcguguccuuuuuccuggccagggugccacuuugacagaugucagacuuagcaucacuagagaugagcccauuauggacuuggaacgaugcugccacuucugauugcaucuucccccagcccaaaauaaucacauggugcucaggaggugccaaauguguggaaauaugggccucuuccccacagcucacaaacacuaaugcccuuauccucaguagaagccauggcugcuguccaaacacacugucccuuuaaggccuauuugguacuaaguaaaaaauguuccccaucaauaugagaaucagaacuccuguguguacuguggagguccuaccugucuguacucucuguuuccuuccucaccacuggccccaaggaccugcuaccaaauguauucuacucggguccuugagaaacggcuuaccaucuaguccagaaaguugauuccaccauaauuaucaaaaccuuuuguuuuuuucagggcuaagucaaucaucucuguagugaagucauccuugugguugguuuguccuccagcuaacauguaauuagcucuuagggacaauacaggguccucaccccugacuaagagaaugaaauaucaauaucuaaauaccuuucuacgggauauuuguucucaauucucaaaaauuuacccaaaagauuuagaauaaauucauaauaugauuuagccuguuaccccaaacucaauguuaauuguuuuaguuugauuuuugauacaggggcucagguacaggauggccuccaacuagcuauguggucaagggugaguuugaacucuuuauccucuuauuaaggguuaguauuauagguccacacacaccaaggcagccagcauauguaguccuggaacuaaacucggaguuuccugcaugccaggcaagcacuccuaucaacugaucuauauccccaguccacuggagccaucuucuaagagacugcaacccgugacacacaucaccccacuguugcuccugugaaaugucuuaggcuccuaguccaugaugacgcuuuuccugcuuuggauggguuauuuuuuccuuaaagcuaccucucaguugguuuuuccagggcagccuagggacacagaauaugguuccaagucacugggccugaagcuucugcaacagguaagcacggaggugguaauguccgauuuacuuaaaggaagaacugaaaaucuagaaauacacguaaaauucagauggaauaaaaauggaagguuuggggcuggcgagauuguucagugguuagaagcacuaacugcucuuccagagguccgaaguucaauucccaucagcuacaugguggcucacaaccaucuaugaugagaucugaugcccucuucuagugugucugaagacaggacagugcauucauauacauaaaauaaauaaauaaaucuuuuaaaguuggggggugcuuagagcugaaacuuacgguugugguugaaaaggacuggacauucauccaaaccauggcacgcuaaucaccgagaaagggggacugcgagcaagacacuggcacuguguguguggccugaagaagggaggaaccugaacugcaucuaacauggauuucuaggcuauggcgcugagugaauggcucuggaaaauccaucugauaaccuggccagcagcagcucaaacaauaaucaccucuacacucugacuugcuuggaacugcacuggaagaaggccugacugugccccucuggaguccuacugaucucucuaacuacaguuuaaaaaugaagcgucaaauucccagccugcuucaaauuagcucccaucaauuuuacccaccaccaccuuugaugggaacuaauuaagcuccugugauuuuuuuuuccccccagacugucuuuuucugcucuggaagagagcauaccaaauuaggcccaucugucuaaacagaaagaaggcuacuuaguccaccgacagccuucuuguccuacugagaaggagccuuggcggggguggggcgguugggggguucccaaaagccauggggaacuacaguaaccccaaaucuaaacaaucugagaagagcggcuuagugcugugucagccaccaucuaccaguucauagccaucauuuccucacacaaugagaugucuggggagacguacacuaggcuaugagacuaucauucauuccagcuccgaaugacaaugaucaagaaucaagggccugggcuggugagauggcucaguggguaagagcacccgacuacucuuccgaagguccgaaguucaaaucccagcaaccacaugguggcucacaaccacccguaaugagaucugaugcccucuucugguguaucugaagacagcuacaguguacuuacauauaauaaauaaauaaauaaauaaauaaauaaauaaauauuuaaaaaaaaaaaaaaaaagaaucaagggccugaucaagaaguaagagccaggacucgagcucaaugguauggcauuggcuuagcaugugccaaggaccuagauucauucccuaacucugcaaaacaaacaaacaaacaauaaauaauagcaggguggagugaagagauggcucagcaguuaagagcauuggcugcucuucaagaggugcuggguucgauucccagcaaccgcaugguggcucacaaccauuugaaugcauaccucuucagguacgcaugaagacagaacacucaaauacaaucaaucaaucaguaagugcggugccuccuuggcagagugcuugcccagcauuugcggucuucgguuccaucccuagcacuaaauaaacccaaugaggugguacaggucgguagucucagccuuuaggaaguagagcagggggaucagaaauuccagaucauuucuuccuaguuaguaaauucaaggcuagaauaagauacauggaacucugucucaaaaaauaaaauagggccaccgagauggcucagggaguaaaggacccugucaccaagcccgaugaccugcuuuugacucccacacacauaccccaagacugagggagacagaaagagaacucugccauucacacagacaaggugacaguuaagaggaaucacugccugggcagugacaaugccauaggccacgcuggucaugauaucuuucuguccccagcugacacggcucauucucagccaccuuucucuagcuaauacacagccuuagaaaucacugagucggugaagaaggagggaaauguaaaaugagggcuggcaaaaugaccugaauuugacccuagggcuuacuucuguaaguuguccucugaucccuacauaugugccccacagcacccaugcaugccccccauugccugggacggaaguugugacugacuuccugucucuuuaaauuuccguuuauguuucaaacacucaccagcagaaaacuuaacuaacucacacaaggcucugggcucaauccccagcacccaugcgugguuggguugggguaaaccagaagaaaagaaacagggaggaaaaagaaggaaagaacuugucuugaccaguccuccgcugguagucaguaacaaaccacagaagcaucuggccaauaauauaaauagcuuuuuucuuuauuggggggggcgggggggggggugaaggaagggaagggaagggaagggaagggaagggaagggaagggaagggaagggaagggaagggaagggaagggaagggaagggaaaaaaaagaacagagggggagagggggagagggagggagggagggagggagggagggagggagggagggagggagggagggagagacagacacuagccuuuugaugacugcacaagaagguuggucauauugccccagucccagucaacacucauucagaagaaccaaguuggucuuuggggcaucuggcaccucaccaaaccuaaccaugagcugacagauuaagccugcaggcacaguugggcuguaggacggaccaagaagcugcaaggcuggaaguaucaaugggaacugcccacucgacagcagccacaucccacaccugcacacucaccacauccagguccugggaaacgcgccguuuccggagcuccuccauccgcucacacacgucagaaaagcagguauuguaauaaucugcauacugcugugccaggucaucaauguuucccagggaaccauccugaggaaggaagagacaggaaaaggagagaggcggucagaucagcccacuuuggaauagccacguagcaucuaauucccugcuagugaguguuuauauaguaauauaauaauauuaauaauuaauuaauaauaaguaauaaugauauauauauauauauauuggcugauugaacacacacacauauauaaaauggcugauauucauuaccugguacucaugggccaggcuguuuuacuugugagauagcaugcccagaacaguccucugaaaugggaccaggucuuuuccuuauuguauuuuuuggguaagcuagcucagagagcacaaguaucugccuguggauuccagggcuaacaagaaaccaaguuucuggaucuauuggcuaaagccacaauaaccaacucauaccugccucgccuggcugagagaagagccaccagagaagcaagugcagucaguuagcagacucuggaacaggcucacugauacccaaccaugaccacggcugcacagaauuucccagaaagcuucucaaagacucagauguccaaacucugaauaaagucugggacuccugacuccaugggaggaggcuacacggaggucauacugcguccccucacgggagacagagaaacagaaaaccuuucgucacuuguguuugcuaggagucauuacucauuguugcugucaugcauauucacgguauucauuagauuuauuauuaauuagacauucaggcacaagagcucaaggcagaaguucaccugaauaaauaaguaaauaugucacucauuucuucgcagaggcagauucccaggcagugcuacggguguacauccauuucugugaucccucaauuaucucucaagcucucagugacacuggguuaaugacaguacccgccagacagugagccagagcagagcaucaccucugaacacgcagaccgccuggcacacagaaaugugcaauccuucuucacccaguggcauucgcuacaaucgguauccaccccgcaguccccaaggcuaguggauuccucagcacacgucugaacacgugcacacggagggugaccaggaugcuacacgggucugaacuaugcauuucuccuaucaugucuuccauccaaaagacacccuccacuccccuguuucuuuaucucucacacggcuucucuaguuuaggugacuugaccaggacagccaagaaaaacaugauuuuguuaagacagccacaacugauagacgaccuaaaauucauucacacccgauuauccacagugcagacuggucaccagucccuuggguucuuagugucagugcauuguggguagcaacagaucucucaccguaaggcagccuaacagcuagcagacgucuucgugcaacccuaagccuuggaggucuaaggacgagagagucggcgaccauccuauccuacuuugucuuuuuuuuuuuuuuuuuuuuuuuuuuuuuauuuuuuuaggaacuaaguugggagcggggcacagaaauugaaauaaaugguuuucuagaaauguuccugccuuucgaccacuaacacauucugccucggagggaacugccucggcgcuccuagcacacagagggcgagagagggaugcaaacaaggccaguugaacaugucugggcaaaaguuugucuccaaauacaaaucagccugucuggggaaaagaaaagaaaaaaaaaaaaaaaaaaagacaggcuagacagagcaggagaggagaaaguccaccaucugccugccagguuuccaguagggaacagugaguggcaagacagaaaaaugggggugcccuucucagugugucugaggagagagaguaagacucgaaacauuggcugagagaacucauuggcaugagucagagucccuauuccaacaacaaccaggccucuggagaacacuggguuccugacuuuguaggucucuccgcacugcggugcuauccucccccagaaacuucugucuccauccaucauggaagcaacacacuugucacgcuggaccaaauacacuaggcuccaucuucuaauacccaaccaagugggcucacugaacgugucaaacuucaugugccgccuugccugcuguugguguguguguuucugucugucugucuaucugccugucugccugcuugcucauacgugcaugcagugucuacugaggccugaagaggguacuagaucucuuguacuuagaguuacagacaguuuugggcucuuugugggugcuggaaaccaaaccugaguccucugccagaacagcaauugagcuuaauugacccugagacacuucuccagcucuggccugcuaguccuagguucugucauucauucucagucucucucucucucucucucucucacacacacacacacacacacacacacacacacacgcauuugauggugaaugugguucaacuggaagagcgcuugccugccaugcugaaagccccagguuugauucccagcacgacauccacagcgcccagggcuucaugucuaugaaucaucccagcacuuaggagguaggggacaggagaaucuaaaguucaagaccaugcucagcuccacugauagcuggaggcuagccugagauacaugagaaaccugucucaaacuaacaaauaaaauggauauuucuguacaaccuucccauuccugagcuauagauucagucaugacugacugcuuacuugaacuacuccaggccuccuaaaagcauuaaacuacuuacaaagguauauucaaacuguauguuucuuuguuuguuuuacucucucucuauauucuaaaggucucucucaauaccgccuaccaucucccaucuaacacuggcuacugauggguuuccuguaccagcccaacaguuggcuuuucagcuccauucugcaucacucagaacuccgcugguacuccggaggccuuaauaaacauuucuguuacucccgagguagcaagcaucuguucugcuccagucaggccgcagccagcucauauuucacaccuucaauauggccauguggccauuccucaugugccgcucaguggguaagaaguuaaagugaggcagcacagcugccuuuacaugcacccaaaucacuucccagaugugcagcgaaucucuguaauugcucccuuucucuguccugaugauuuaaaugccaaaguggccaaagacuacaagaaugcaagugucuuucaaaggugugucugccauagucacaaaauuaucuuuuuuuuuuuaugucccaaucaaauagaaccacagaaauaccuggugauucucuuuuuauccauuuaaacuccaagcucucaaauuaaaaacaggaaacuaguaauaaugaaaagggagggagggaggaggggaauuuacggucuugaugacagggauguuuucaaugggaagacuggucuccaagcucacccaggugugugcauuaagucugcaaagcuuuuuaugggaccaucagcucaaugucuguucuccucuggacagauauuuuuuuucuggguguguggggggcaggggcagagcauggagaguuaauuuguguucuuucaaagcgcucugccgaccucaacauuacuuugaaccaacucgcccuuguuugacauacauguuuccuacuuuaggaaagcauuuaccccccugaguaucugcaacccaagccugugcagggcuuucaaugcugcugcugaucuauuccacccugcaucuucuugucugucucaguuuucugucucagccuccacaacgcuggaauuccagaggugagccaacacacccagcuugcaucuuucuuuguggaaacugcaccuuucccuacucuagaagguucaccuuaaauguuauuaaauaaucuacuagcaaaaaaaaaaaaaaugugacucuguaucaugucuucaguugccaucauaaacaccauuaagaaagcccugaaacauuccuuuuuucuuucuuuuaaaguauuuaguguuggagcuggagagauggcccgagacucaaggugcacuugcugcucuugcagagaaccugaauucagcucccagcacccacaucagauauaggcucucaauuaaaaauacuguguaaguagaccguucaacuuugagucauauuaucuuccaguaggaguuuucuuuccauuccaucuucaucaacaagaaaaagagcuaugggcaaauccaacagcucuuuccauaauaacagugcaggccgaucaccagcauccauauggaaucugugugcaugaaaccugggacccacuagacagucaguucagugggugacaaacuguaaccugcuccugaggccaagaagcacauuucuaucuggcacuuuauacagcauaaagauacaggacaaagcacuuuaaacaaacaguucagauaagauggacugcuguugugauggggggguggauuuaucccaguggaacuuuuguuucuggaaaauguaaaacugaagggucuaagaaaauagaagcuauguaucuggauauuuuugcucucuucucuccagaugucuuuuauggcugagaaaaccuuugacagccaaagcaaagaccucugaaaacaccaggagccaaggugagacagaucuucuggcgacuacaugcaaaugaaugcaaaugaaccaguagcaaugagauagaucuuauguagauuaugcucaaaugaaagcaagggaacuaauggucuucuuacguguauuugugcaugcgugguguaugcgugcauacaauguguacacaagguacccaaaggaauccagaagagggcaucagaucuccuaaaggcugaaguuauagggggucaaaagccagcugauguguuggaaaccacacgcuggugguccuuuggaaaaguaguuacaucucuaacugcugcauccuuuuuccagccccuaauuucuuauuguacguuucccuaaagguaaaagcucuaggagaaagccagugugguguuguaacucuuuaagaguggacagaagaaaggagagcaaacuccugacuuauauucucucuccauuucaguccuuuuaagaacaugcaugguguacuuuuuagaauauagauuguauguuuuauuuauauugcuccuuuuuuccuuggauagagacugcaugaguccaugaguguauguacacacacacacacacacacacacacacacacacacgcacacuccauuaaaagaaaucacugcacuucaaggaagccuaacugaucuccuaaaaugaauucccaaugcguuuucauccuuaauuagcuugcuuaaagguuuuugagcugauaaagacucucagguaaaacugcugcaagugaacagauagacggcuuuaguccugguuucuguguucagccuuacugaauuucccaucccaucccaacuuguuguguauguuucaagaaaugugcugaacauauaauaacugaucucagauagcugauuaaucucuaaggcaucguuuccacuauuucuagagaugguuugaacuggaccacaguccaggaaaaagaauuaacacauacaauuacguaucuacacuaaggggaauggauuaugaggucauggagaaagggagggcgggagggugcacgccuacauagcagguggcuggcgggggcugacuucaugccuuccauuccccucuccaaaauacccagaacuuaccagaaccuauauaaguaauucucucuuuggcaaauaaggucucaauauugcguguaggugugucucaauuaacacaaacuguuccugacagaaggcaagauggagcauucgcccuguccucaaugcuuagcucucaaggcuagaccacuggguuccccauaaucugaaggaaaaaaauaucagggaaagaaauggggcuauagaacccacucaaugaguuuucuaucucuucacaagcaucuacucauaucaguccaauggguuuuuauucuacacuucccugcaauauacaagaguguaguucagugguacagcuuuuucuccagccaugagaaaauugaguuccaggacagccaggacuguuauacagagaaauccuuucucaaaacaaacaaacaaacaaacaaacaaauaagcaaaugaaaacgcaacaugaauauuuauuguuagccgggcauaguggugcacgccuuuaaucccagcacucaggaggcagagguagguggauuucugaguuccaggccagccuggucuacagagugaguuccaggacauccagggcuauacaaagaaauccuguuucaaaaaacaaagaacaaaaaaaaaaaauauuguugcuggacagacuagcaaagugugucccuuaguuuacuuaaugugguuagacggccaagccucagaaauguguuaaagggaguuagugaacauaaggucucuuugcaauugcagccucuaaaagagccauucuguuagccauguaugauaagaacccaaggacuugaaaaagcagaagagagcagggcacugauaaucugcuuuuuaaauacaaguauaauuucagcccccgugcacacugggaucuaacagauggcaauuuuaggcugaacucauuuuccaugucuaagcugcccugagcuuaacagagucccagaucuggaaggaacagcacaguuaguuagaugggaaugaagucaccauuucaggccaugcuugcagauuuugaugagggugaaucacucuucucucaagcugacuuuggcaccugaacccgagaaugaaggcaauuuuauuaaguaugacugaccaagaucugacugggaaaaaacuagucuaugacauucccaaauuguagcaguaaguaagguaaucaugaaacuucugaugacauugucaaacacuccacaauauaugaguauucugucaugcuugaaaauuccuagaaaaugauauucuucuuggggucuggcuggcucucucugcuauucuggcccaccagccuccugugcugggcuuccuuuccucagugcaaauggagaaacagguguccuagccaacuguaucauaccugguggauagcagccaccacaccuguaauuccaguuguucaaacugcuuuucgaugcugcuaccaaaaagccacauacuuaagaacuaacagguaacagcuacagagucuuugucaccauaaacucacaaaccggcucccaccccaugccacagauagucugacaugauaauccugcuuugccaagaacucauagcgucgggagggcagggaaugacacagagauaaaagaagagucaguagggauugaaaauucuagcggugacauagcaauucugugacagucucucuacuuuugucuacaccugaaauagucuauuaucaacggucuuuuaaggaugugcuuauguauucguuaucagcauaacacuuccuagacuuuuugaagccuucagcuagggcuuguaccuugucucgacuccauagcaacacccuacauuuaaccaguuacguaggaaagagcaguccagugagaaugcuucccauucacccgcacauuguacccgucuccagagcuccccaguucauucagcaacuacgaauugagaaauuucccacuauaccacauuuuuuaacgguguuacuuugauuucuuuaucuguuuuuagaugugugauaccacgucauacacgggagagucaagagauagcuugugggagucgguucgcuuccuuuaucaugugggcccucaggauuaaacucaagguccugaggcacgguggcaagcuuuaacuuucugggccaucccccuagcccuacaucaucauuuuaaugcagacugguaagcuuuuaaucaauucuuauucucacagaccuuaaacccagaaugcaagucucgugagugagacagcggaacagaaacguaucucuagaaacuguggcaaguaaaaaggcaugggaaguaagaaaucgugggaaguggcucguggcagaagcaaggacaguggcucuuagauucuaagagauagaccaacuuguuucaagaagaaaagcuacuuaagacuaaagcaucagagcgcagagguccgguagguuagagacagaugagggagcacaggguuggggcuucuuggugagucgauaaucacacauagcucuuuaagcucggagagguagcaugcaaauauucugcuugaaauagccaugugcguccaggacaaucaaaucacacagugauuuuagagacagugucacugaucucaugaacagcacauuacacauaaaaucguccucaagaccuguauggcagcaccuugccccuccccagcuagaaaaccaccacuaaggaaaugaggaacugauuuucucuaccacaucucauuucugucaaguuaugcaaccauccauccgcgugcugcugauaccagcauucaucacauaagggaccccaggagaaacacaacgggaugugugugucuccgugaucgcugccagcggacaucuuccuaucuuugucacagaaaggcuugcaccccaacaauaaagacaagauuuaguugaguccuuuuuccagggauagcuggucaaccagggaaagaaaagcuacauggaauaaguauggccugugaaagaaggaaucgugcuguggccaaggauaccaggcauggaugaagaggucuuacaugugaacuccucucggccaguuauugguuaauggucuaugguaagauguagcaccucucccuaguaucuaaaaugguagugguguuacuaaccaauggacaggauuaaguaaaacgcauguagcauacaucuauaguaguagggcagcugguacccaggaaauauucaugacgucauccuccuuuauuaacaggaaggcaaaagccaccccacauccaccccuauuauucgaaagaaccgggucauaccacauggucacucacaggacuccaauuuaauauacacagagacaccuagagagucgggaaggaucuggaacauggccucaucugaacgaugaguaaugggagcuggaaggcaagguguugacauucuaaguguuaauaaugcucaacauacugagggcuauaaauguucauguaagccaaagguuauuguuucuuucugcuuguuugucuuuuccuuucuguucucuguuuggggagcagggugucccuguauauagcccuggcuagccuagacucucaaguguucuaugugaccauaggcuagucuugaguucuucuucuucugacuaugguaaucaugaccagcuggauuuguuguuauuuuguuuuguuuaccuugcuguuaugguuuuccuuuugcccuuuuguuguuuugagucaaaucucacuccauaacccuggcuggccuggagcucacuauguagacuaggcuguguuugaacccacaaaaaccuaccugucucugccuucugggugcgggcaguaaugguaugcaccaccacuccuggcccaaagcugauuuuuuuuuuuuuuucaagacagggcuucucuguguagcccuggcuguccuggaacucacucuguagaccaggcuggccuugaacucagaaauccgccugccucugccucccgagugcugggauuaaagaccugcgccaccaugcccggcuccaaagcuaauucuuaaagcaaaaagauuaaauggaaguuucuuuaauguaauaugguuaauuaaggccauuaagggcuugccaucuucuggggucccaauauuccaccaucaugacuuaaauagcuggugugguagcacaugccuuuaauccuagcacucagaaagcacaggcaagaagaguuagagaccagccuggucuacauaaugaguuaguuucagggcaguccuugccuacacagagaaucccuguuucaaaaaaccaaaaacagaaaagaaaaaaacuagaaaagaaaaagaaaaaagaaaacaccagaagcuugucugccugacuccuugauauuccacucacaucagacaggcagaaacaggaaagcacagcuggaaagccucagguccagguguggaaagaaaacaaacaaauugcaauguuggagccacagaaacacgaagacuccuggggcaaugagcaaacaggcaggucccaugccgagggcaaaggagaaacgucuuauucuuauuacugacaacuguuuuugagcccuucuuucaauagacaucaacucugggacgucucucaaaagucaagaugacgauaauuugcccaggcuccuggaaaagaccccaaggaccccaagcaacauuuucucacacaccucccgccacccccagccccaggcuccuuuguggcuagcuucuggaaccaaaccagucacgugacagcuccacugugguaagaaucucauuuucaacucaaguucaugcacagguuauagaugggaggagugacgguuucaccucaaacaacucucugaccccuaagguacgggaaacugggaguagggagccucuguuucacaaaacggcucuugcauaugagcgugccuguuccaacagcugucuguccaucgacccauacaacugugugaacgcaccaccccggaggagcagacagucagacuugcuuugcgguuucuugagagcugaaaguucucugcucacuccauuauuucucuucuggaugcucucaguuuucauccuaaaagacauuugcuuuugccaaaauauauaauguagaagugcucugacagacaccggacgcauguggguugguucuuauccucaaacuuaaaacaucugagaagcugagagcggagagggcucgauuccuacccaguucugcucuguaaacgggauguuccucuuaacaccugcagcagcaggcaguaaauguacgccugucuuuccagaugcagauggagggaagagaaauguccauuuuucucaaguagcccaugagcugguggguuacuaaagaacgccacuggauuccgugugugacaucuaauguucuggaaucuacugcccaugguagggggggcggcaaacugaucuaacaaagcaugaacauuucuaccagcgcaucaaucagagccuggggagcaagucuuuacucaggcauccccagcugcucguucacacauuugggucugcaaggaugcaaucucauaugggaaauaaacuaguuaggacauguccacauuuuccuuuugcccagacuacuugccucuucugaauggccuuauaaaaagaccgggggggggggggggggugaggagaggaucaguuucacuuucuucuuuuugauguggauagaacaaauaaugcuuauuuuaauugacuacgcuguugggaggaaagccuacugugaaaauuaaaugugcuaucaaaaucuauugggguuucggggagggagguuguuguuggguuugagggggggucgucuucgguuuucuuuuuuuguuuuucuuuuuuuaaaggaaagucugauucugucaugacaguuucccugauucacaaacacggcagcgguucaaugacucauuuuauaccugguaaucgaaguuuaggcucccuuguugugaauacagugguuggaaaguccuaccagaaccuaacagcccaugacccacugacccacugagcagacuucuuucuuaaguuccugcuucauucugaguaagggccacagucucggugacauagcaaaguaaaaggcaacacagggcuggcgagauggcucagcacuuaagagccuaggcucacaucugucuguaauuccaucuccuggggaucuggccucuucuagccuuugcuagauacucaaaugguacccagacacacauacaugcacaacacccguagacauaaagaaugaaaacuuauauaauaauaaaauuaaaagagaugacacacuggucaagccccugccuggcucgcuucaucccucuccggucccagucauccuucaacacgagauggaugccugcuugagaaaugccccugucucugccugcucugcuuuuccuacuuacuugcccucaccugcagacauccuucagcucuucugagccucaggacugaguaagucgcucaguugauagagugcuugccuaguagccacaaagcuccggguucaacaucagcucugcauaagccagauaucaucagaccacacaccuuagugucagggaggaggaaacaagagaguauggcauuccaauucagccugggcuauaugaugucuggccucccaauaaauuaaauaaauauauaaggaaaucgcagucuccuuccccuauaucuaaaaggucugacgaauucucuaccuuacaugucuuuuuccacuuucuauagcuaaaacaguuuacuaccauuaauuugaucuuuaucuccucuccauuucucaauaaaauguugacuuccagccaguugguggugaugcacaccuuuaaucccagcgcucgggaggcagaaaggaacagguggaucucugugaguucaaggccagccugguuugugagcucccugacagccagggcuacauagagaaacccuaucuugaaaaaccaaaacggaaaaaacaaacaaacaaacaaacaaacaaaaaaacguuguguuccagagagagaauaucuuucugaguuuuauuccagguugaggaccaauguuuagaagccucucaauauaagcauauuaacuguguggacaaaggaucaugggggagagaaaaaaaucagccgauccaucaguaagcacugugccaggcugggccugggggcaaaugaauaguaacucuuuauauguugcuuuauguuuuaacuuuuccuuuaaguaacaaaccuacuuugcaucccucagacauaaaaguagcuugcauguuuuaauuucuucaacucccaugucuucauuauaauuuaaaaugccaguauuaacucugccagugccugcauuaguaaaucucaccaaccucuuuguacgguuucaaaagaaacaaauggaauacaguucaagguguuaauuacacacgcuuaauaaaaacaagcccccgagacugucagcuccaacacccgagcacuuuuauguguguuacuuuauuaguuuuauacaugugagaaagucaaacacaguaagcauaauauugcaaaauagcuucuaccaaagggaaauuauuccacuccauagccaagccuacgaacagcucuagucuuuaaguccaagagucggggaacauagcagcagcagagacagguuucugcaugcugauggagacagacggaggcgagauggugugcucccuucugcaaccacggcucaaacggggagacaguuauuuguacucuccuaagauguccauaugaacugggggggggggggggggggguauuccagacauucugugccuuugggucacaaagugugccuguggacuaacuggauaauauuuugugugauaacuagagacaaaguucuaugcacaacuaugaaugggagaaauuacuguguucaaaaauauuguggaacaaccccuuuugaucuccaauccaggaccacaaaaacaggaaauaaagacucuccuccacagccuuuaguguuaacugugcucugaggaacagcagguaccucaguucccucugggccauggggggcggggggggggggggagguugccugauguccccugaugcugucucccugugcugcuuugacucuaugaauaugacagagggauguccgggcucugcagcuaccugcagaguggccuuggguguuugucaugacucuaggucucaaaagcaggcuggacagauggcucagcacuuaaguuauguauggcuugccacacagcuauaagaaccagaucucagguccuagcaccacauaacaaaccaagcauccuaaaaguaccgguaacucccacucucuucuggcuuuuacaugcacgcgcgggugcgcacauacauacauacauacauacacacacacacacacacacacacacacacacacaaacacacgugcacacacauacaaugugcacagacucagaaacacacacacacacacacacagaaauaauguuuuuuuuuuucuuauggguuucccagacaggguuucucuguaucccucuggccguacugaaacuugcuuuguagaccagguuggccucgaacucacagaaauccaccugccucugccuccagugugcugggauuaaagguuuaugcacuuccaccccuggccaauaaauaaaucuuuuuuaaacagagauuuccaauuucuacuugacuucauuuucuccugaacguuaguccaacaaauaagcaucuuugcuuccugguccuuuuaguggcaguggagccccugcucggaaagacaaugaaagagggggaaacagaccuugugggaaacuuuguggcuccguuaaggcuggcauuucaacaguaccuucaggacaugcaaaggggaguuaggaagcaugagacgaacaugcuaucugcagcaguuaguucauauacgcaucuuuuuaggucauuccucauuuaguaauaauuagacuggaauauauuucugaaaagacaugaaacucauaacucuaaagcagagagaaaauucaauuagaggaagccaagauggagaagcugaaggcugagagaaaagagaaagcccaaaggggagucauuucaucuagcguguucacaggggcacaauucaaggcccagaggaucugggccacuaucucuaaaccucuccagagagaacugcgagguaacucuccucucccccggauccgaagucuugcugucuuugcaucucuaggcugagacuuacuuguuccuugggauggcaaugaauucugcacacauucucuuuguguuuuauuucauuugucaauuuuuguuuuuugagacagaucucauauagcucagguuagcauugaacacuauguagccaaggcuagacuugaauuccuaauccuccugccucugccuccugggugcuaggacuaugugcuuacaccauuaucuaugacagcugcauuuuguuuguauaaauuguuuuucaauaaaagcugcacacauagaccuaaaagaucacucacuugaguuucccaccuccacccucuauucaaggagaaaacaguauuuguuauuaauagauugccuaauuuauaaauuuuggguaaggaagauaguuggauucuagguuguuguuuuggaggguaguuuuuguuuuucccucuauuccucgcagaacgucugaguuuuuagucaaugaaagggaagaacucucgagguuaguuuaggacuaacaggcaucucccugucauguguuuuuacuuugaaacaaguucucauuguaguccaggcuauccuuggccuuccuauauuagcagaggauaacccugaacucuugcuccuccugucuucgcccuccuuaggacugcaagugauaccagcacaccugguuaauauaguacugguaucaaucccagggccuugcaaaugcucagcaagagcccuauaaacuaagcagugcuccccccgcagcccaccccucccccagcucccaccuuauaugguuaaauaaaaaucagugugaauuacaguauuccucggcuacacucagcacacagcagaggaagcacaugccugggugcucagccagcccaaacaaauugucacauccuuagauccaucauuucuuccugaggccagggcuuucagcugacccggcagcagccgugagugaccccacccaagguccuaugggaaaaacugggccucagaugcugaugcagcuccugccugagauuuuggcugacucugggcuacacugcauccugagagaucuggugccagguccagaaccuuggucuaccacacccaagcuccccagcccacuugggcaagaggcuggccugagaauaugcuggcugggaauggagggccaaggcacacacccuagcuuggcuuaggccagggcagggggcugcaugucaucacauccugaucauggugccacgcccuccucaggaaggcuuccucaggaaauccugacuucuccagaaacacaguggccccaggccugaggacaaaaacaggagccucauggucuguccuuuguucuguguccugcaaaccuguccagccucugguucaagaauuuuuuggcgcaggacaacuaaggagugggcugagcugccauggcuuguagaaccagaauuuacaaguccggaaugcacagagcagcuugcaugaagacaaccucugucgggacugagguucucaccaaaagcugauugguuuugaagagggaaguuacacuaaguggcaaagagguuaaggauuuagcuuaguagguagagugcuuacccagcaucacagggcucuagguuggauccccagcaccgacugcauaaaccaggacagaaauccuaucacagggaagaagaaggcauguggauccgaaguauauucaucaccagcuacacauggaguuguaaggcagccugggcaacguuaagaccacagaugaacaaagcaaaagacauagaccacugcaaagauagguuuucuauucaguggucagaaugcccagcaugggccucuguuuggacuccgugcaucccuuggcaucucuucuagagugccuggcacauagaaagacucaaugcauaguguuaaaugaagacuucuccucccgagccacuuucuggcuuucaccucaaaauaggcacaugcgucaggaccacuacccagagguaugaaaaggggaggagaaagaggaggaguagaaagaaggcuguguccuggccagcauccuucucacacccaccagccccauccaccucccucuuucacuccgguagucuuuugauucuuccuuagcaucagggguauuaacauacguucucugcucugaugucuuaaugaacccacgucucauggagccagacagaaucuguguguuccucucaucaguguagaaaagugucucccucauccagccccgcuuccuacccaucuucuucacccacccacgucacuagauacagaugcuaccagauguuccagacuguuccagauguugucagacuggaaggcaagcuggcaccugaccaucauagccaccaccauaccacagaccaguaauggcuuguguguccuuucaggggcuguaacuaaggcucaaguauccgcugcagggcaguggaagccgauuucuguguuuuuaccgaaguuuacuuugcuugaucuguaaaauggcgaugauaacaacaaucccuacaccucagcacacugggcugugcucaggucagagacaagagcugugaacgagcacauggccugcuccccagcuacaaugaccuccaccaggaauaacuacugagggaaggccuagggcauuaccuuucuacagccucauccgugaaaggaaugauuuuuuuuuccccuaaggaauagugcuggaguuucaagggggaaaaugggguuuugguuauguuuuguuuuguuuugcuuguuugagguagccuacgcuggccuguuuaugagaugcugggcaucaaacccagggcuucaugagugacaagcaagcaucuugccgcccaagccacauugcccugcacccugaagagaucucugacauacuuaauuaagucagacacaauuuuaacccaucgauaccacagugaacauuuaaacaaaaagcuucauuaaauuaucugaaaugauguuuuuaagaccugggaacugcaugaaugccauuacuuacguguuagugauuagucagcgugggaacaaacuucccacugccauagaccggccacaccuuaaaagggugaccauacaacuucuggccacuguacuuccuaggaguaagagacuuauaagaaacuaaauucuaauugaaaaggcaggaagggggcuggugagauggcucaguggguuagagcacccgacugcucuuccgaagguccagaguucaaaucccagcaaccacaugguggcucacaaccauccguaacgagaucugacucccucuucuggugugucugaagacagcuacaauguauuuacauauaauaaauaaauaaaucuuuaaaaaaaaaaaaaaaaaagaaaaggcaggaagggguuggggaaugacugaaggccaucucuacuugaucggauguacuuggacguaucggaaagcagacuggaacagucauaucugagagugcccuccccaugugaaggacggccgugguuuucauucuccuccauagguacacauguaacagacucacuacaacacaagcacgggguacuuccuuccccauccagagcaggugcuaaguauuaucagugucuuucuucacaaugaacucaaggcgacaauucaaaguccuagagaggcccgcuuuuucacaguaugcuugagucacuaagggaccacgcguuauccgucuaccacggucuacguuagacgaaguccacucucguggucaauucccauaacuuacagaguucugcacgcuaugagagauguucucgcucaggaaaaaucaaccugaaagugaagccacuaauacacccaaaggggguggggcaaaacaaggaaauaaaagauauucuaaacgcccagaaaaccucagaauaggaguuacacaguaguuccacaacccaucagguuccagauauaaaauagaaggggagaaguuacauagagggggacagagcucagggccaccacuaacuaccugcugagcucauccucagggcuagaccccuaaucagacagaaaaacccaccauucaccucuccaagucuagacggaacacagucagugaggcucuucuugcuaugucuuggacuccugcacacccacccaacucuuccucaagcugcaucuuacagcacauuucuuuccucaacacccuguucucaaaaccagucuccaucuuuccacucacgccuccccuuaagucagaacaccucuuaccugggccacuacugcagcgaggaaggagcaagacccaggagguacugaagggcuguggaaagaaggcuuucuaugaggaggggacacaggaugaaguaggagagugacugacgaggaugguaaugugacccccucccagcucugugcagcucuguccauuuacccaacaggccucggugaaaauaagaagacaagcauuucauacaacaaaacccaacaagugcccaaggcuacagaagacugaacgucaaacucaugaugcaaauaauaaguaucauaaagauuacacaggaaaaaauaaagauuauguggacaggagaaaagguuaauuuuacgaugucaggacaaauacguuuuaaaaaguaaaacaggacugacugggagaggggggagugagggaauaguccacuaccugcauaggacaguacauuccugaaaaucuggcgcucaggaagcuaaggcaggaggauugcuguguguucaaggcuagcaccaggacaaccagagauacaacauggcaaagaucucaugucaagccuuccacccccuaaaagaaacuguccagauuuggaagccacagagcagagccaauagcuuggaacuugccuggccuuaacacauggaagcacuuaauagagacuguuuuaucuaccaugaaauggucuucauuuggcaaaaccaguaucuuuauuaauaguuugccaaguugcgagcugcuggaugguggugaugcccgugguagaacuuaacuuucaacuugacccugauucuugcaggaaaacauuccucucaccuuuaucauuuccuagccccaaagcaaaccuagccccaugguccagaacuucacuaugaguagacucaggacaggaaauaucugcauuucacugcagugucuacaccccgcuccuucaugucuauggcucaguuugauuccaagcaaccccuucuuucugugaguggacagcccacugggcaauccuguagcugcaugacuggcaaaggcaggguggcagcugugggccauuucgucuaucuucuagggaccuuuuccuccggaagcaugacucaugggccucagucucaacuuaaaaauugugcuuuuccucuguaaauccaaaguuggcuaaugggaagugugcuggucugcaucauagucuacaaggggaagugauggaggucuuggccugagucacugggcuggaaguggauggucaugagcuguaauauucuacaaggaguggaaaacgcuuaacagggcuggcuacagaugagucaggagucuugauuuuucuaauugaccauuuuuauauuacuauaugaagacauuccucuggaugcauuuagccugggugaauaguagagauuaaaaugaauuuuuaagugacgggaugaccuauuugauuuuaauuaaaauguccaacacagacucuacagggaauaaaagauuuuauaaaugguuuccauuuucuccacagccucccuuccgcucaucccuaaucauuaguaaucuggugaggagcgauuucugaacucccaaagauggugucacaggcgagaugucuguccagugugccagacagaaaguggugccgggagggcucccaacacggagaacuuaacuaagccucugucgcuccuucccuaguuuaguccucaagaacaccaaggguuaggggauuucgcucaguagaaggcauacaccaccagaaucgcauuugcuacaauggcuggguccaucaggaucuaucaucuuuacuucucuucucaggugucaugauauccacguccccaaauccuuuaccagacagagcccugccccacaccaucuuauccacccaaccuggaaguccguucuagagccuagcaucaacgacacuaguuuuuagccuguuuuguguaguaagguuuuucucugcgcacccucuccuaguucuuuugccucagaugguugagauggggaccuacaggcaaaaaguugugcucuucggaaaacuaagcuuaagacagcucaaaggcguucuucaggcucccaaucaucacugcuuuuuguucccucccacuucaauauaaaucacagucaguagaggaagaaaggaaggccacagggauuucucaaacgugcauggaaguagacagacacacucuaaugucgccccaaggcccaguucaccuguucaguucaggguagucucuaucaugaagugcuggacgucaaacuuucuuucuggucuuugcuucuccucgcuaaauaccccgaggacuuaucuaccucccccauucgugcccgcuaaacagcuauuccugacucugucuccaagcauccagacagguuuguauugugcugcccugcuucucuuucuuucuuucucucucucucucucucucucucucucucucucucucucucucucucuacuuguugaggcauugugcccuacaaagugauuauuuugccuccucucaguggcuuugugcuacagcaccacagagccagagcacccuacccccuccaggaguguccuacagcugacuauugcaugccaacaacgaggaggcuucaaacaacaggaauauauuauguauugucuuaguuguugagaccagaagucagauuuccccugaaaccuguagaaacaggagacucuuggcuucuucccagcuaguggugugccaacaacucuugggcacuguuuagcuauggacaccucuccaguaugaaucuccaaguggugccugacugugacaauguccaaaucucucuucuguaagggauaucaguuauaauugaaaaccauccuaaugaccccaucuuaaaacuugguugaauauacaaagaacccacaagccucuaggaguuaagacuucauccaugguaaugaccuaacagcaucccagggagaguuaaacccacaaagagacuccugccgcguguggcacugagaaugcacucagugacagugucuaaugcaguucuuauuauuccuagaucaccuauucuuuucgcccuauggcaucuuuguuuaaaaaguuuuaaaagagaguggggccugagugagcugggcugggggaaggggggaggggagggggauggguuuuaaaaaagcaaggcaggcggauuucugaguucgaggccagccuagucuagagagugaguuccaggacagcgagggcuauacaaagaaacccugucucgaaaauccaauaaauaaauaaacaaacaaacaaauaaauagcaagucuuaacccagaggggugacccgaugccagaaucccaaaucuagggauaccaagacagaaaaaccacaaguuugagacuccucugggguacacugcuagaucuugucuaucuagauagauagauggauagauagauagauagauagauagauagauagaugcaauuuaucuuugcagcagccaauuuuccaagcagacacaaaaacaccaccgcccaccaaacaccuugggaaaaauguaauaacaauggaagccugggugguaaacugaaggauguccuuuguccuagggaagagugcuguggcuuccagguugccuggaaugcaaagcuauguaggaaucacugaagggaggcuuccaaagaaccugugggcacgaugacaacugaacugcuaaguucuuuugauuucuagaaaagaacuucaauccuacuaugcagccuuucuauagcgccauauagcuagcucuaucuguauuuguaugaauauauauauaugaagcuaugcauuauguauauuuauacauaauauauauuauguuacauauauuauauauaauuauagaauacauaaaaauacuaacuaaaaaggccaaggacaauagaagguuaagcauggcuauagaagaccaaaaagguauucagcaacugucaauccauccaaaagagagagacuuaaggcuuauagcggcguucaguugacuaagugcugauguagcauacaggagacccugucccaaagcaugaucccacucaguuuucauuccuaagaagccauggcacacgccuuaguuccagcuauguaugaggcuaagacacaggaucccacaaggcuaggaguuugagaccaaucugagcaaugaagcaggauuuagccugaaaauaaaccagcguuuucaguguguacaagagugacaaccgagcagcuguacagccccggcaugcuuuucucugcacucagaaagcuuguuugaauacagacucucacaguaccacagaacgugguaggucacuaccaccuacuccucccaauuaauucgcuaagucauuucucuaccaaaacaacccuuggagccuuaccgacaaucucugccaacuccauugcauaauucucugaguauuuaucuugacaugacuagcaaaugcaggauucaaaaccuaugugcuuuggcuugcucucuugaucucuggcugauccucagaaaccaugaguuaccuagugcccuugagcaaucccugccuggacucuguucuccguguguaaggaccugaagcagcauacucaaacuugucugcaagucuaucuauaggcaggcaaacaauagauuuaugugucuugcagccucaauguuuuuaugaagccaacccucauauuugaacaaacaacucuaacacuugaaccacuaguuuggccaacagcaagagacugucuuucccaauguuggggaaguggggcuuccuguuuuccaaaacagaagagacuggaaaucacaagacuugguggugguguuccagagcugccaucagcacagcgacagucacaggaagacagccagucucugugaugcucucugguucccugcaagcagugaguuugcagcacugacccaaagaaaacauccaacaucuccacaaccagguagccucgugaaaaaacagacugcaggccacuuucuggcuaauaccccccuacacacacacacacacacacacacacacacacacacacaccacagcacaccagcagagccacauccacugcauccaaucaacugcagcagagggcacuuuguauacacauaagacgaaaugggcaagccuagaaaccugaacuggagauuugcaaaagccagacucagcuaacaacuauugaauuguggguacuaaaacaugugcgauaaaauacagcaguguuuuuuaaaugaaagccaggagcucgagagauggcucaguggguaagggcacuuucuaccauccccaacuaccugaguucaauccccagagcccacacagcaggagaggguaaaucuccgcuuaacgcucucacaaacacacacacacaugccauacucaaauaaacaaaugcaacucuaaaguaaauaauaaagaaaccaggaagcugaaacugcuuaugugacuaaaggacagugggugccaaccaggguaacuguugguaaguagcuaugacagcauuuaauuggccaaggaaacaggacacgcugucucauaccugaaucccagcucuaggaaaccugaaccaaaaggaucaccaaugacuucaaaacucagcugcauaggcaacuccagaucagccuaggccaaaaucaggaccaggaccccacccccaaaaaaaguacacaacaauaaauaaacugauccuccauguauuuaagacacacuacuauaugucaggauaaaacuauauacaacuaugcuuagucucaccucuaaaacagaauuagagcaagggguacggcaagacccugcuacauaucuccccacguuuaaggaguacuuggccccauuuauccccccucuugguuucuauggaaguguuuccacuauagaaggcauccugccugccugcuauagugacacagacucccagaugugucagcugaaagguccugacacagaacaccaaugggauggguguuagaguaucugacccagcucugcugagacgagacauugcucuuggcuaacacuaaaguuacaucacaaagauuuuccucuuccucucauguaucauuuauacaugaaucauuugacaccuacuuaauacucaucgugaagucucaguuucauaauguucccaucaaggcgaacggcuacaccgaauuaguguugcaaggcucuuccauuagacuacuaccuggacaccacaggagaccuaggucccaaaaggaugcugcagaaggcggucgugggcauaccccaagaggcaccgccuaauacaaacauucuuagaaaguuguugguagauuugcaauucauaagcaaauacaccuucaaauggaaugcuuugcccuuuauggauaauuuauucacagucuuuacagacuuuccuccagaucucaaaauaucugcuggacauuuucuauacauucauacauguuucugcagacuuuaauaguaaaguugguuccaaauacaaauucacauagguagaaugcuugccacagucacagcguccugggcucacugccugaaccauguacacugaugugggguacacuccuuaaaauccuggcauuuggagauagaagcaggaggauuagaaguucaaggucaucuuucaccacauagcaagcuugacaccagguuggacuauaugagaccuuacuacaucaaucaauaaauaaaaaguaccccaaaaguauauugaugaaacacuuuauuaaacaaugggguuuaugauuuucccugaagccacagaaacucagcaaauaaagucaucaguuaacuggaggcuuuuaacacauugcuuguuucuauuaaagugccuauuaaaaugcucucaccacaaacuguaaggaacaacaugaagccuaaacacgcagacagacauaaaggucucacccuugagagagccacauguuccucacacacacacacacacacacacacacacacacacacacacacacacauuggccugccuucuacacucaaaacaaaacccaaacaaacaaacaacauacauuuucuucauuuaaauccucucuugcaugaucucacucagauguggagacagaacaaagucaaucccacagaagcugagaaaagaauaaugguuaacagggacuggagaaaggacucugcagucgacggcacuugcugcuuuuguggaagacccagguuuaguucccagcacucacaucaugggacucacaaccacccauaacuccaggucugggacauccaacacccucuggccuccaccacaggcaccuguacaugugugcacaugaacuucagugcacagacacacaaguaaaguaaaucuuuuuuuuaaauuaacaauaauaaauagggcuggagagauggcucagggguuaagagagcacugacugcucuuccagagguccugaguucaauucccagugcccacauggcagcucacacaacugucuggaacuccaauuccagagaaucugacauccucacauagacaucaugcaggcaaaacaccaaugcaaguaaaauaaaaauaaauuauaaauaaauaaauaggaggcuggguaugguggcacagcauauugguauuucuugucuaggaggugugaaguucuagcaaccuagccuuggaggagaccaccugcaauucuaacacaugggaggcacagacagaaaaaucuaugucuauguaaaagccaucuugcucuacauaucuaaugugaggccagucuugaccacaucagauccagccuaaagauaaauaaaucaauuaauuaauaaaagauaaacuuuacucucuuauguacuuguaaauauaaaaaaaaacaugagacuuuucucuuaaaaaacuuaaaaauaaaacaucacaccuuauuguauuacuuagacacaaugaaauauuaaaauaauauucugcuggguggugguggcgcaugccuuuaaucucagcaauuggggggcagaggcaggcggauuucugaguucgaggacagccuggucuacagagugaguuccaggacagccagggcuacacagagaaacccugucucgaaaaacaaaacaaaacaaaauuaaauaaauaaauauaauaauauucuaaacaacuuuuaaacagaaaucacauuuucauuacaaacuaucauuuggccccaagaaaacccuagcuauuacuaagauucauguuuucuccuuugaauacagaaaauauuuuaagaacacauuucuuggcauguaacuugacaaguuaauagcuugaaaugacuaaugaauuuauuuuuguuuuucucucucuuuucauuuuguguuuugaaucagagucuugcuaugcccauguuggccuuucauccuccuccuccaagugcuaaaguuauaggaacgggccacaaagacuggcugcucauuuguuucuaaacuguauacaagaaaaggccauuuaggggcuggagagauggcucagcgguuaagagcacugacugcucuucggaagguccugaguucaauucccagcaaccacaugguggcucacaaccaucuuuaacgagaucuggcgcccucuucuggagugucugaagacaacuacaguguacuuauaauaaaucuuaaaaaaaagaaaaggacauuuaagauagcaaagcaagauuguuaacuguuuauuucauaaggccuuuaaaacccaccuccauuauaggaauaauccuauaacagagauacacauuuuugagcuaaauaacuccuuuucucuacaaauaacucaauauggaacacuauuuuuuuucaaagcacacauuuuuuuaaaauuauauaaacuaaucguuuuugcuccaaauggauauauauacuuguccuacgacaaggcuuagacaguaaaaacagacaguacuaaaaaccaacauggucuuaggaugaauuucaguagcugggacauaagacacauaugaaaaaccgaaauuuggucuugaagggcacuuagcugaaaguaugugauacauucgucuauuuucuucucuauuaacuacguccuaagagaaagaacgaagccgcgagcagauacacagcacugauccaccauagcgcgccuucugccagcaccugcuucaaaaucaugaaaaccugauuuuggugggcucacaucugcaauccuaguuggugacuuacaaacaauuccgcuagacuccucccagggaccuagcaaccguuacgucaucaccugccgccaggugggggugguguaagaggacugcaccccaccccacuccccucucucccucaucuccgucucuuucccuccuucaguuaccacgaguucccaggcggccucucuuucucucuguccuucucuauccccacuuucucugcccucauggcuuugucugcuucuaccccuucuccagguccucauugcccucccuccccccccagaauaaaccucccaggucugucacguggcaugauuucucagguugacaccuuggcaugccgccccuucccgaccccacucccccaccccuacccccugccacuacggccaccaaggcacucuggaaaccgaagcaggaagacugaaacaacuucaaagcuagugcgggguggggcacauagugaguuccaacccaguucgcaauacagaguagacuccgucucaaaaaggaggaagaggaagaaaggaaggggagggggagacggcaguggacugggugcuaagucaacugugcagggagggaaucucaagaugcccagggaggucagcagggggucucugcagacacaggcaacuucaguuugaaagcgcacagucuaaauacaugugauucccauuucuaccagacagcuuucaaagauccaagacauaggcaagcaccaccccucaagccccccccaccaaucccucagccccccacccccaccccggcccagggacugauuacaaagaacuggagcauccaguuucgcucucugaggcagagcuacccugccugcaagggcaaucucuuggauggagauguggagaacacagagccuaaugugccuagaaagacacaggacagguugucuccagguggcaucccccucauaaagaauugaugcugcuaaacaaagcaaaagaggcaguaggcagcuggcaaggagcaaggccagugagcagggcugccaugcucaggucccauuaccaaggcaauuaaaugaaugcggacacuuuugaggcauggcagugccuguguagcuaccaaaauacagcuuaccucaaaacucacccgaagcuucgguuaagucuuagaggcuuggugcacugguuuaugugggauaguucauccagaguucuagccuccagucauucaaacucuuccauaagucaggaagacccucagaggugguggcaacacuagucuagcacauaugagaccccgggcucaauuuguacuccaaaacaaaacaaaaaugaaccacaggauuuucuugcuauaguuauaaaaaccuacucuauagcaagugugaauuuuaucagguaaaauagacaacagacaaccaggcuacaaagauaucucauaucuaauccgaccuuccuaaugcugugacccuuuaacacaguugcucacacuggggugaccuccaaccauaacauuauuuuugcugcuacuucauagcuguaauuuuguuacuguuacaaauuguaauauacacauuugauguucaggauaucuuauaugugacgccuaugaaagggucacuugacauuccaaagggucccaacccacagguugagaaccucuggucuggacuaagcaaugaagccuuuauuauuauuuuuuuuuccuuaaaguucauuuguagcuggguguggugguucacauuuguaaacaggacuugagagagcaagguagaagggacuaugagcuucaguccagcauggacuacauaagagcuucaggccacccgagcuacauacauacaagauuauaaaaauaagauauauuguauuuggugugugugugugugugugugugugugugugugugugcgcuauguauaugcacauugugugcugguggccacagaggucagaagaggacucggauaugaucuuucuaaguguugguggggaacccuucauuucuguuauugcugagucaaacguggggcuuggcccggcagaggagagauaaugaagaaauguauguacauguagccucugcucucaucaccucuaccuggcccacuacugcagccuccaaacucgcaggauucuacuguuguugcugguauaaaaacccuuucugugaguguuucauuucuuccuccacgucauugcuagucuauuaccaccaacaugcauuauuuuucaggagcacaccuugaccaggccugcuucacucucuauuuaaaccuaauccucaagucaguacccaaagaccaacuugggguccgucuugacaugccccuccuccaguguggccaucgugacugaauacacugcuuuccuccgcuuuagcaggacuugucuuuuucacugacaaaucgggaugcaggcacaagcaugguuuguuggaacagcucuuaucuacugaaaggauccaggaucagguacacacaggcucagucuagcaauggaacaccauccucccacuugcuaagggcugccucuacccugucgccacauccaaccacagagaagagagacaguucuuaugauggaacaaaagggccagagaaggcagagaauggccaaugaaagccaaucagcaagcgaccaagaucggagguagcugggaacaggcgccuccuauaggagaaaacgcaauuuccccucucacucugaaggcuugguuugggcuuuguggcuugguuugguuuggcuugguuuucucaggaagacaaguaaccuucgggacuaccuggaccaagucaucaaccaaacucaccuggggacccucccagccugcgcagguaaggcacaggcuuucaacagacggaaagauuccagcgaggucagaguacuuuuaagccaagguacuccacugcagccuaccccagccccaucucugcccucaggucccuguagcugagggacacucgugagcuuccggccccuccugcuuccgccuccaguggagugcugggcggaaagacuguaggccaucacaccaggcugggaugaugugguugguauuccuuggggcaggcuaggccggcaggcuacccagcgagccaccccuccaggccccacucucaaaucccaauguguaaauuuaauuagaucauuagcugauaggcuuaacucaagacaccucccaaggguacuuguaaaugaacuaacuguucccugaggagucaccuuucuaaaaucccucaggaucucacuaacaacucuccucccccacacuugaccugacaaagaaucaggaauggauucuuuaguuucuucuucuccuuucacugaaggucuggguucugcuuuauuucgaaacugaaguaugcagcaagacaucuaaauacaauaacucugaggauuccugucuacucugcaguuuuccacaacuugcuuaagacucgggaccuuuccacacaauggguauuuucagugcagugcuaggaacuggggauaaacuacagagucugcaggggacagaggaagcucaggguugggggaggugugccuugcaggauccuggcaacaagaaggauuuaauuaaacuucuuaccaguuaguagcuaugaagccuggcuuagccuuagagguccucaguuacuagaggccaaaacuaaaugaccauucccauuugccacaagauuaagcaguccuagaaaaauaaaauauaaaaauaaaauaaaccagaaaagagaagaaaacuucucauaucuaaaccacauuuaaauaaauuuggcaauucccacucuucaaaccaaguauuggccaggcgugguggcacacaccuuuaaucccagcacuugggaggcagaggcaggcagauuucugaguucgaggccagccuggucuacagagugaguuccagaacagucaaggcuacacagagaaaccuugucucgaaaaacaaaaacaaaaagaaacccaaaaaaccaaguauuguccccaaucaagaaccugaggguagccacgguaaauagaaaacaauuauaugggacuugaauaauucugcacuucugggcagacaucuguugaaucaugccauagggaaaggugcuaugcuuugaaaaucuaggccuggccacacuguaauaccaaggggggcggggaaauggcauguuugugcuuaggauucacacacauuucacaguuugcuauuaccuuagaagcgccuggauuuugguuuggcugauggaauugcccaaauguuagcuucugcaggaccagaauucauuagcacccucaaaaggaacuuguuauagggauauuuuaaugagacuucuguacuucacaaguacacaguucuuuuuugacuuugacacuaugcucuuaguacccaguuaauuccaggcacugggaccugaacacuggguucagaugccggccgaccccacucuccagauaaugagaaguagagcuuuccaugagacagucucucuucaguuacaauuucuguauugacuuauuagugauauuuauucuaucacugcuuacuuuccaugguuuaaacuguuuuauuauucucucagcaaguauuuuguuaacaauuaucugaaagcaaccauuugcugcuuaucugugcacugacugaauuaauuuauaagcaaaaagguguucuugugaacucaaauauucauaccuuguuuacugaauuagagcuaauaaauuaacuaaugacgccaugccacagccuucccuagauuauaacguagaaauuccacccucccccugccuuggcccuguuaggaacgggggugggggugggggggcucucauuguucagcacucucagagauaggguccugcucuucuaccuacaaagguguucaccuacuagggugauaggcaauggucuggagucagaucaaacauugucaccaacaauguacaggccauuagucaaacccuucagaugacuguagacuuccauaauuaaaaacacaaaauaaaagaaacuguaccucauguuucaacaaaaacggagccacccaaacgucaccucugugucuugaaauauugccccaaagauguagguuuuaauaaacacguggaaggcagcucucuagugguagcaagagcccuccucauaacauaggaccuucccacuaguauguacagaggcagggcagccaggucuaccucucugcauuuuacuaccgaaugcccaacguuugucccaaaggaaauggagacuguauaaaggacaggagaagggcuggaccauacugacguucucuccugcuucacacucaacuccaggcugaguaagaaaacaucuauuuucucuuucaucugcucuuugaauaccagguuugaucuucuagggccccaccccuucuuuuaccucagccaaagaacacucagcuacagcuaccccgacagggcuggaaucugccagggaaagggaugcaaauauucagaaagggugaccugccaauccuccuccccaaacagcacucggugugacuuucacuuuucccagcacuccccucccccacccacccacccagggcacacccaccuaaaggauggcaacaggagauacuaucaaaccagcauucucugacugaaaagucagaguggcuucugggcaagaaccaagauaaggugucugccggucuaaaacuuaagauugucugucaccacucacaaaacaaucgcuugauuuccugcaauucaacugagcauuguauguaucucugaaaaaguuuaggaaacgcaacagauuuuaaauccaaaagacuuacguacacagcauacauacauaaaauucuaacguagguaaauaugucuuuuauuauguauuugaaagcacagacagaaaucuuuaacccaggaaaaugagauacacugaacuucaagauguccaaaaagaugagacauaggcucuauuugcaagaaaaaauauauacagagcuguauucauugaccaucuaccauucaucuggcaauaugcugagugcaucauacacauggacauagugccucucauaaaacccaagacacaugucuuccuguuuuucaagugaauuggagagucaggagugaaugaccuugauaugguaauuguagacagacaacuggggagcagggauuugaaccaggcuaacuaacuucaaagcccaagacuuuaaccacuauggagaaaacuaaacacuguaucgugcccaaagaggcacugcuaaaacccuggggagcagggauuugaaccagacuaacucgcuccaaagcccaagaccuuaaccacuaugaagaaaacuauaucguuccuaaagagacacggcuaacaccagagacacggcuaacacccuauccauccaagguaaaauuucauccucaguagaacuacuuuccagaacuaagauaaauccauaggcaguuuuaaccacuggccaguucaaaaccucuuuuggggggguuugguugguugguugguuuugguuuuuggguuuuuuuguuuguuuguuuuguuuuguuuuguuuuugauuuuggguuuuuuuuguuguuguuuuuguuuuguuuuuguuuuugggggauuguuuuguuuuguuuucgagacagauuuucucuguguaguccuggcuguccuggaacucacucuguagaccaggcuggccucgaacucagaaauucgacugccucugccacccaggugcuggaauuaaaggcgugcgccaccacgcccggcaguucaaaaccccuuaucagcacagauucagcaauauaugccuuauuguucucagcgccaaacauauaaaacaaauauccuguaauucuacaaacuagaagagcugagggcagagcaaguaaacaccgugguaguucugcacaaggaaacgguuguuuuccucucaugggcacaggacaagcccugugcggauaaacaucaauaccgagaggccaugaggaguccacucgccaaauauuuacaaguaguauuuacaucuacucuuucuggcuuuuuccacgccaacuuuucuaagcaggugucccuaauuacagucgauuguucaagaggugucucugaugugacccgacaaguagggguuuuuuuuuuuuguuugguugguuugguuugguuugguuuuucuaaauuacaguuucaaccccuauauagagaauacagcggaaagaagaagggugaccaauaggugggcgaggggugagccccgcuucccccgccugccuccccagguagcucaccaggaugcccaucacgucgguccagaggcgggagauugacucggagacaccggccucgggcuccagcucccgggcgggauccaccuccggcucaggcuccggcgccgggcuagcagcucccgcguccuccuccauggccgcguccccgugcguccgcguccggguccccgcgcugcccaccgcucgcagcagcgcgucggccgacggggcgcaaguuccccgcccgcggcgucaccgggccgcgcccccgcgucgcaugccccaggcuccgcuggguacgagcaccacugccaggacuggcaccucgaucccgggcgaccgcgauugacaacuccagaaacuuuucc

SEQ ID NO: 12449 - RNA, 65845 nt, Mus musculus
cagcuggcgcuggcggcuuccggccugggugccaggcuucacccagcgugcagcgcgcaugcgcaacucccgcaggugaguguggcgacugugggcccgggaucugcagccugcgaggagggccgggcccggcgacaggugccugcagagcggcugagguaggugagggugcgugcgggcucugggguuagagucgcggcggagggaggcuggcucugcgcgucagggaaacuccgagggcuccugcgcagcuccgggauccggagugaucggcccugcgaggccccgcggcucggccccagcccggacgugggccgagcccuucucgcgugggacgggugcuugcugcccacgcuugcgugcugaggcccugucacgagcugucccuccggcuccuucuucgaggauaacuugccuugcaggcuggcggugcgugggacgacagguagcugggagggaugcagaggccgccaaguuaggcuggcaaacucucaagcauuacagucgccugcagaagcgcccuggcuccugugcauugugugcacuuugacgcugcagguagcgcuagguuggugaacgaagauguugguuucugguuaagguacccugugggaggaacgguauuguuuacagucuugccuuuucaccguggugccuuuuaauccacuuggcuugaauuuaucauggcaagucuauguuuuucuccuacguguuugccuuugcuccuguauuugccuaggucccaugaucgcuaacaccacuuuauucuuugucuaagcuuuuacucuuugucucaguuaggguuuuacucccgugaauagacaccaugaccaaggcaagucuuauaaaggaugacauuuaauuggcacuggcuuacagguucugagguucaguccauugucaucaaggugggagcauggcagcauccaggcaggcauggugcagaagaugcuuagaacuccacaucuucaucugaagccugcuagcagaauacuggcuuccaggcagcucuugcagucacacacuuacugcaacaaggccacaccuauuccaauugguccaaaccuuugaauagugauacucccugccaaucacacuguuaauccauaaaacuaguguguguguguguguguguguguguguguguguguucuucccuccucuguauaaggaucgaucgaaguuuuguuaacgcuuugggauugucaagcucauuggaauuaaaagagcaguggugugggguuaaauacaacuaacaugugagacaggcauuuauuucugauguagugagagguuugucuuccuaguuguuggccaucaaguauaguauuauaauuugucuucuuuaaugggauuguuucuuaacugaaaauuucuaccaaacaugagugaaacugucacagcauuugauacaugagaucaugguuaaaguguuucuuaccuguuaguuuuguccuugaggugaccaauuaccaaucccuucugaugggaagacacagugggguguucuuguugcagcagcuuggucacaccuuguugcucacaccuggguagauaagaaaacagacaggauaggaaacaagacuggucccccaggcucagcaaccagcaucggacucccuacuccuaggccccaucucaguucugacauguaaucugugaggagcuuuuauagccaaagcacagcagcuauuacuugacuuaagucuucuuaucaauuuaccuauuuugaagaguucacauuauauaacagacuuaaguuuuguguaagggcuacugaggaaugugccuaguaucacaggguuauuguuaagauaaggaacuggguuaggaugugcuucaugaaaugaggauauuuucacugugaaugaaagucagagucuugugugugagaguccuagaaaauauccaguagaggagugaggcccagccuagguuugugcacauuagggcuguaagccugaauauugcaauguuuauguuuuuguuuggaacuauuuccucauaaaagauauaucaccucaguguugguaaccuucacagcagauguacauuguuaauuuuccuggagucuagauuugcaguuagccagaggcuuuaaccagacuugacuguauggacucuauucucuuaguuuuccugucuuuauccugccucacaccaacuauuccauuugucauuuagaauucacauuuacuuaucaagaaaguggaagcgugaaaaugagcagccgaaggaaacgugcucccccgaugaaggucgaugaagaaaggcaacagcagcuucacuggaacaugcaugaggaccugaggagugagccgcucaccaugacggucggggaacaggccuguucagaugcagacucuucuucugauugcaucaucaucgaugaaggcccuccugagagugcacuucacagagauaagaagaggcguucagagacugugagcgucuuagaggccaccgaggaagagacccguuugucugugacuuugaauguuacaguuucucccuaucguguggauaauucuuggaaagcauuucugggagauuuugcucuucagcuucuccccaaagagaguuuaguugaacauuuuucugaaaggacuuuuacauugaguccuucagagucaagcagucaguuccugaucuauguucauucagaauguaaaaauguagagaaacaagaaaauguucuugaaggaucagccgguguuuguagcaagggaauccgaguggaauccuccuucaguagugacauguuacaggauuuggccuggcuacagaagagaagaggaauaaaacucuaccagagaccagacggcacucacacaaucaagguacucagggucugugguguuguguaagguucuacacugguaauucauugauguuaacuuugaaagucucaaaacccagcaguaagcccccguuauuaaguuucaaagaauaacuuuguauggggcuuuaaguaacuguaaaacugugucuuccugccagucccaacuagccaggcugugcuucccuaaggagacucuccugguuuucucuuccugccucugugcucuguuaacugcuuugguucucaccaucuugcauuauaauaccuucuauuuucaaaucuuucaucuauuuuguuucagaaaugguguauuugaaaugugacuuaauuuccugauuguaaaacuuaaguguaaccuugcuauucugacuuaacaacuugcuaucauaugucaugaauuuuacccuuugucacuauuuuuuuauuugguuccugaaauuccaaaauuugucucccaaacauauucuguccuucugucugugcuuuuuuugguuuccucuuccccaucucugauaguccauucagaaagaaugcauggaugcauagagaagguuuuuaagucccaggcaugguacuacauauccuugcccaguguaucuauuuucuuuuuucuuuuggcuacuugugaugguuuguauaugcuugguccagggaguggcauuauuaggaggugugaccuuguuggaguaggugugucacugugggugugggcuuuaaaacccuaguccuagcuaccuggaagcaagucuucucauguuugccuuuggaacuagauguagaacucucagcuccucccccaucaugccugccuggaugcugccauacuccucccuugaugauaauggacugaaccucugaaccuguaagccagccccaauugaauguuguucuuauaagaguugccuuggucauggugucuguuuacagcaguaaaacccuaagacacugcuugaaacacacuaaaggcggaaagaaaaacccuaagaaauuguuucaucuuugugucacugaaauguuuuucuuauuucucaaaagaaauuauaucuguaggcuaauuauuauuucugaggagaucugguguguuuaggguggaauggccauagauuuauuucugacuaaccuaaagaauaagagaacauuuaaaagcauuauacagcaauuaacuuuuuccuggacaguggaucucaaccuugcaauucccugccuacugauuuugaggaccagaauuuugcugagagcaggaaaguaagaaaucauagccuaugugucuguauucuacccuuaaaaccaugucguaaugucuuccauuuucccugaccuugauugggcuaaguauguaaauauuuaagccaucuccaggugaacagaaugcaaauaugaacgguucugaaauggaaucuuugccacuuguuccaguguaauguugcuggauucuuaaaauuucagcagaaaaaaugaaggauuucagucauuagggaauuagcccaggauugcuggagaaaugaagaaaaugcauuguuugccauuagaaaucuuaaaaauuaaacuauuuagacuacuucauagacuuuccauuuuaaaaauaaaaacauaugaggcuaaauaaaaguuauguuuccuaaauuucuuuuacuccuaaauaucauugucucuacuuaaauuugaauauuuccacucuuaggauucaacagcuccauuguuuuguaaguuaagauacuuaccauagucaaagucuguuuuuuuccacuuuuacuuccuaugacuggguugauccauuauaaggaaucccaaacauaaccucaaaaggcugagcuaggaaagccuccuuguaccaugcuucacugauuguucagaugcccauuagguucagaaaccaguguccugguggguagaguugagguucucaucacacuguguuuugguccccuuuaagggagucuuuuuguuuucauuuuucuaauaaauaaugcaucagauauuuauagaacgaaauuaaugaaaauaaaaguauaucuucugcuuguggagcagacauuguuaaaaccuuuaaaauugugaaucuggagacuggaaaacuggcucagugguuaagagcacuggcuguacuugcagaguuuaauucccagcacucacaugucaucuaacagucaucuguaacucuugucccugggucaccacuguccuuguauagccucgauggucacugcacacaugugguacacagauauagaugcagauacaaacaccauauacguuacaaaagaaaaagaaagaaagaaagaaagaaagaaagaaagaaagaaagaaagagucugaaaaagccuuucuguguccuuauaaagaauuguauacucccaguaaaacguucuguguguuaauuguuuguagguuggaauuuacauuuuggaagcuggccuaacaagacuagacuucaugagugaugcagguuccagaaugaaaaaguucaaucagcucaugaagagagugauggaaaaguuacauaauuucauuauuccagguaauuaccaaaguaagaauuacaguugcauuuuagcauugccaguuucuccucaacuuguacacauagcagccugaaaaacaaguaguaaaaugaagaaacuugagugcucuugaugcacugcugugugacaaacucugaaaugccuuacugauaacaauuugcuuuuuuacuguaauugcuuagugucgugcccagcauucagaaauguuuguaaaagcaguagacaaaaaagcuaaaagccacucagaacacaucuaaacuagcugaauuucuauuuauuuauguauuuauuucuuagcuuccuacaaaauuuuuaugaagcugguugauggauuuucuuggcuauucugcaacaauuuucaguagucagagauuaugcuggccuuuagucuguuucccugcagucugauaaagaagcucaagagguacaguccuauaaggaacagguggcuugguggguuguuggcaggacaugcaauucgugguuagcaugcaccuaaggccugugaauacuaguaaauguagcucagugggagagauaaaacaaacaaaaagcgcuguugguucaauacucucugccacagauagacauggggagugacugagggggcaccuagcucugcugcuggagaaacagcuugguucuccaaauuacaauggagaauuuaaggugcuuguguuuucagguauaauuuuucuucucucauuccuuucuuuugucuugcuuuuuuugguguugguuuuaguuuugguuuuuuuggguuuuuuuuuuuaaaacauuuuuucuucuuuuuccuuuugugcuagaugucaaacccagaacugcacacaugcaagggcuacacuucugagcuauagccucagcccuauacauugucauguuagaguguuuugaaaaucuuuuuuugaacauaguggguacaugguugccauagcucauucuuucaaaacuucacaauacuaguaauagugacuuugcaaguuagagauuuacaggaaagaaaauaucuuguuucauaauuagaaaugcuaucaaauccaucuagaguauuuuuuucaguuauaagaauuuuagccagcuauguuggaguacacgccuacacugccaguguccgggaaggacaacuucaagcuuagcugucaaugcuugaucacauuaauuauuuuguuguugcaauaguaagagauaaguguauaauuucucugugugguugugauaauccuaugugauacuuuguauugaaaauaauuuguacauuauucagaacacucuuagucauugagcauauuagaugcauuugugcucuuugagcacaaauugaaagacuaacucaagugugugugggauuuucauuuuguuuaaguuacagugugaaucuucuacagggcauuuguauuuguaguaaaaugggauagccugacaugcuuacauuaauuaaucuuucagcaugucucuucacuaauuccugcugcuaccaaaggccugcccuuccuucucgaccugaaaaauuaauaaaccuuuuuuuuuuuuuuuugguuuuuuugagacaggguuucgcaguguagcccuagcuguccucacuuuguagaccaggcuggccucgaacucagaaaucugccagccucugccucccgagugcugggauuaaaggugugcacuaggauuuucuaugaaauauaaggauuuuuuuaauguuaagauauaaaagugauaaaguaguuuauaaauaacaggugaaauucauacucaguuacccauauuuauuaaauacuuauaagagcagaacaugucagugucucugagguucugugacaaguacacaggugauugaaagagcagauauauuacagucaaaguauaaaauaacacaugagcacugagcagaaaauagaugacaugcagcauuugaaugcuuuuaaagaaugcauaggugaauauuuuuugaagagggauuuccagucauggaauacacagaacaggacuguggagcuggcuggcugcgugggguuuccuggaauaaggacuagugguuagcaagccuuguauagcacaugcaucuccauucccagcuccuugaagaaaacugagccgugaggcucuuaggggugagaccaauccagagauuauugaaaagugucuaaaaacacacgugggaaggguuuaaaaagaaacaauugcuuguggcuuacaaugcagacucuguuauauaccuuuguuggauauacagaugugcuggaagaagaggaggaggguucagagagcgagcccgagggucaggauauugaugagcucuaucacuuugugaagcaaacacaccagcaagaaacacggucaguccaaguggacguccagcacccugcguugauuccgguccugagaccuuaccagagagaggcagucaacuggaugcugcagcaagagcaguucagaagcgcuccuccugcuggcaaguauaagaugcuuaaagaagggcuuaucaggagggacguguuacagauaguuaauaguggggcauguauuggggugacggcaaguaaucauacugaaaggagaauaauuuucugucuuucagaauagaugccuagauaaauuaauaugugacuuuucuuauuuguaaaaguuuaaacuacuucuuccuucagccuuaaugggaauguaugaaaaguauaaaagaaauaaauugaagucauggucccugcuuguaauuucauuuggaagguaguagcaggaagauggggacucaagucaccccaggcugugguguggauuccaggucgccuguuugggcuacgugccuuggugucucaaaggagagaaggagaggaagagggugggggugggggaagggagaggaagaaucaugacuugcuuacaaagaagugcuuuuagaacuuuguuaauuauauguaagaaacuuccuaacuugacaguaaauauuaucaacagacagcagauuugcaaaugugacuaauuuuccuaguuuauauuuuuugcuuuccccacaaaaucaauaaagccaagagauucauugcagggguguacuuuagucauaacuuuuguuugguuuugaggcacaaucuugggguaacucuugacuauucuggaacucaauaacuguguagaucaaguugaccucaagcucuaauuagaauucauuucccugccuccuaagcacuggacuuaaaaguaugcagcacuaggcuggcacuguuuuuaaaugaguagacaaauucugagauuuuuaccugacucuguacaaugaguuauuaacuaguucugauucuucuuguauagauuuacuuuuagcuaacuacagauaauuucuuccaaauauucuagcaaccuaacuuuuuuuuaaguuuuccuuuuaggaauuaucaauugauaggcaguauuauuucuucuugcucuuuauccuguuaauaccaauacauuugucuucuccaaauuaccuuccucaucucuauuucccuaucuucuacauucucauucauucauauucuucuucauucucuuccccuauccugaaaucaacaucuaacuguggaguuggaugcucuugguaaaguuucauaaucuguauguuuugcugccuagcucucauucagucuuuuccucauuauuauuuguuugggaaauuguuaguccuauaaagucccacauagaccauauuauuuuuucucuaaaauaaaauaauuuucggauacauaauuuccacaaggaauaacuuacauacaacaaaacaguuugaucuuaaagguaauauuugauguauuuugacaaaucuguaaacuuggagucaacaaccaguucuugucaggcuuccaccagagugacagagcauaucugagaaaaucaucuccagagaaucacugagugggaugguucagugcaaggaugacuagccugauggcuuuggaccugaguagacauuaggugucuagagggacgaaauaccuuguuucagaaguagaggaaugcuaucaaauacaucuuagccagcuaugguagagcagacuuuagccgcaaguguuugggaaggauuacauccaacuuagauaucaguacuugauuguguaauuauugaguuguaaugguguaaaguaaguacauaauugcacauugguuuuguacugaagguaauucguugauuauucaguguagucuuagucguugagcauauuguguguguucacaguguguacacugcagcagugacaugcagcugaggagcuccuccucucguauucuaaaacagggagaggggaccaggacuagaaacaguccccaaggccaguuucaguaaggaccaacucccuuuacuuggcuaucauuuccaguuucuacuaauuuucagaaagcccucaaauuaaaguauaguaaacacagagacacagagacacacgucugcacuuagcaaaugcagaaaacccuuaccagguuggaauuggugcuauauauuaguuuucccccuuagcuguguguugugcuuugcucuucuguguuauuacuggcuuaugagucugugcaaaagcaaagggaacugacaaauaguauuagaggaauacugugagaggcaacucuguggcauuucccaaaugagccuucccaaggaugugagucuucugaaucagugucccaugccauuuuguuuaucuuaguaucacuauugacaggagaaaaaaaaucaaaacaaaagcucuuauaacuuauacuucucuuuagauaacucccugcacuucuuauggcgagaaauuguuacaccugauggcuugaaacucuacuauaauccauauacaggcugguaaggcaaaaucuuuuaugucugauuuuuauaaaauauauacagaaaaaacuaugagaauuuaacacaguguucaguauugaggaguacuaaaagucuuauauauuucuacaguuaggauagacuuaaauuaaaaagcacuugccauuuucucagugaauacaguuauaauagacuguagcugcugagcuaucaagauugacagagaugacugggcauggugaggcaugccuuuaaucccaguccuugagagcuagagaguaaaggagagauuagauuuaugucucaaguaaugucguuuuuuuuuauaaaggccaacuuuuauacuuuuaauuaucaauuuauagauuuaagaaaugugaugaucuuugagcauaauuagugaaucaguauuuauuaucuuuuauauuuuuaaucacagauucauaaagaccauagagggaaaauccugccuucuaaaaauguuauaaaauugcauauauuuauucuguggccaaggauggagggguagcauggcauaccauugaagguagaagaugacuguguuuuaucaugcuuaucauaaggacugguggcagucacuuuugccuauuuagccaucuugcuagaccgcauaacauuucucuuuaauuauagaugagauaaauguugauuaaguacuagcaccauucuuauuucuauguacuuaguugucugcucaauuauuguuauuauuuuauuccuguuagguaggauuuggaacuuugacuuguuuccuccuaaaugaaguuucaguaaacuuaaaguugcauucauuucuucaguucucuuugggaacuaauaaaagacaggauuuuauuuaaauguuucuuggguuguauuuucucuuagcaucauucgagauuucccacaugcggguccacaguugcuugguggaaucuuagcagaugagaugggucuuggaaagacaguggagguucuggcucugauucugacacauacccgacaagacgucaagcaggacgcucucacccuuccugagguacagagaaaugccgugcuccagagaauaggagcaaaggaugucaggaggccgugcagugagcacugagcauuugcucgguucuugcgucaaccccuacugugguggugugaaaauggcuuguauucaggguugguuaccugcaaguaacugcagagaaugggacuuugguuuccugggagguuuucuuaagugaugaagaccaacuaguaagggaauauacaguaguaaguuuaucagucuuccaacuaauuagcaggacuuuuacaguaaguccuguuagugcgucacauaucuugucaacacuagaaggucaauauugucacugaaugaagaacugucuguuuaauuacagaucucagauucuguuaaguagaacuuagugauugacugauagcuuaguauuaauagauuguuagauggaguaguuuuuguauaaauaucugaauuuuagaguucacaaaauauaauuuccuauaccucccaguaguaaaaucggaagccagcacguuaaaucgugcugaauuuagccuaccaaucaaagguuaaacuaguuaagaaucucuaggaaccacugggcccacaauuuuaauauuuauauaauauguuaauaaauucauguaugcauaaugaaccuuugugauuucaauaguaaauaguaaagaaaaaucuuuauauaucuuuguauauauguuuauauauacauauaaauacauuuuuauaaacuuauauaaauauauagcuaugauaggggagguugaagaaaagauucaacaguuaggagcccugagcucuggcugcuguccuagaggacccaggcuggauuuccagcacccacccauggggcaacuaaccaucuguagcucuagauccaguugaugccucucccucuucaggccucugugggcacuguaugcauaugauauacagauguacauguauacaaaauucccuuccacagaaaacacaaauaaaucuuauuuuuaaaaagacacuauauaugaguuaaaguauuagcaucguugagagauuuuuaauuaaacucauuacauauuuuauuucugaacuuucguuauuuuaaauuuaauguuucaauucuauuuuuaacugugucuuuaaaaguuacuuucaguaauucccuacauuuaggaaauuuagaguauacaaauuaaaacaugaugguucguuauaagcuccaaaguggaaacauugauauauaaugaaugacauuuaguuaucucccaguugcauaugaguauaugcuuuuuuuuuuuuuguuuuuuuuguuuuuuuuuucugagacaggguuucucuguguagcccuggcuguccuggaacucacucuguagaccaggcuggccucgaacucagaaauccgccugccucugccucccgagugcugggauuaaaggcaugcgccaccacgcccgacuuauucuauuuuucuaauagaagggaugauuauaacaaauauuucaacuaccaaaauuauguauuucagggaaaagugguaaauuauuucaucccaacucacuguccuagagaaaaagugaaaaauagagaaauccaggauacagaauaugaaccaaaagagaaaguucacugcccucguaaguguggucucuucacgugacuucuuacagugauuuuacuguaguuuaaaauguuauucuuauaaagauauuaauaguaagcacuagguuucaauuuuggggggcuuuugguuuuuuuuuuuuccauuuguuuguauuuaacacagagcaucguuacaaguuacaucaaauauaaagaauuggucccaguacuaccugguuagccuauuauauaugcuucaguuucuucaguuuuguuuaauuucaaguguaguuuuuauaauucuuuuuagcagauggauuuucuuaggaaucguagcauaacauguacuaggauauucaagagauuguuauuuuauaauuugaaugauuguugugucaucaaauuaacaauuagccuaaauaaugcuuuguuaaauuauuucuacuacaguaauuuuucuuaauucaagguaaauuuuuauuacauauucuucagaauacuagguuguauuaagucuuuuauuuguacccaguccuuaauaaagauuaagauugaauuucauaucaauuauuuugaauaauuaucauauccuuuugucuaucuacuguacauuuagcuacacgugugaugauccugacagcugugaaagaaaugaaugggaagaaaggaguuucuauucuuucuaucuauaaguaugucagcuccauauucagauaugauguucagcggaaccggggucuucugaagcggauguugaaauguuuaaucuuugaaggucuugugaaacagaucaaaggccaugguuucucugggacuuuuacacuggggaagaauuacaaagaagauguauuugauaaaacaaaaaagcagguaacaucauuuauuaagugcauguacucauauacaacgccuuacagaauaaaugauuagguccugccuugccacugaagcuuucagagcuuagugacaaaagucagaaaugagugagaaaagguacuguggcaaugacggacuuaacaguccuacuuucugaaugugucacaagaguaacaacuauuuuaguuaccauucaacccugagaaguacucaauggaaucaacucuaaaauuaguugguuuaccuuaaaguuuaagguaacuugucuauuguuaagaugcugucuguauuuacaaaccuugcucccagcuuuagaaauguuaaugccucaaauuguguauaccuauguauaaaugccucaagucuuuuauauaaaguuaucauguucccaaugacgucauccuguaaaacuuuaauauuuuucuauaaaacuguuuucauuuggcuaguaauuucaauuugcuuuuagaaaaauagacacaguacauguaaacaccauuaaggaaaaaaugacgacaaaucagaguaugaaagccuuuugcuuggcuacuguaagagauaguagagaaaauaggcacaguucaucucucagagcagagaguguccagcuugugcccaagcacgcacagcaccaggagcugggaccucuaaccagggccauuguucuguauuaauauccugguucuucugugugcccucaauucugaccccauuuugggggagcucuuccuaucaccuaccuggcugucacacuccgacucucugacaugcucuuuguaagcccuucuauagugugcuuuuacuuccuguucagagacaaugccuggccuggaacugauguucaaaccauaaugacaagagacacccauagaaaggcaaagauaaaagucuguguaccgauggcaacaaauaguaaucacccuucgcuuuauuuguacuugaugauuuggaguuguauguacucuaaauuucugguuuugcuugauuuaagcagacuuuaaaucagaaaauguuaauaacaaagggauagcuuaccuucuuucucaucagcacuguacagggaucaaguagaaccuuugcuucucugaagguuacagagagaggucuuucagaggguaaauuagaauauguuuaucaugaacaaguguccuuggguaaagggugguaaagacacuauugacuuuguuuguaaaggauauauguauauaaaguuuagaguuuaauuucacaauuauaacuuuauugguacauguuaauuaaagaauacuuuucauaggcaguagggaguccaaggaaaauugagaaggaauugaggaaaucagugaacaaggaugcagauucugaguaccugccaucaaacacuucugaugacgaugagccuuacuauuauuacuguaaggcgggaaaaagccggaguaaguugaagaagccugcuuuacuaacuaaaaagggaaagggucagucuguucaucuggauucccaaggugaugcuccagcugcuggagucugugcaaguacugauguucaugugucagaaaauacaugugucucugaagacaagcaaacccaagaagcaaaagacugugcugagucgccaaacccugcugccgaggaguuggcacagucuaacacuucaaguccuugugaaaccucugauuaccgcuuugaguguauauguggugaauuugaucaaauuggccacaagccaagaguucaaugucugaagugucaccuguggcagcaugcaaagugugugaauuaugaggagaaaaaccugaagguuaagccuuuuuacugcccccacugucuuguugcgauggagccaguaucaacaagagcaacucugaucaucucuccgagcuccauuugccaccaguggguggaugaaaucaaucggcacgugaggucaucaucucuccgaguucugguaaggcacugcagcuagcgagggguuagaaccuguacaguggugcuuaucugugauaguucucauuguggcugagcaagaucucguguaacccaggauaaguuagcuccaaggaugacguuggaauccugguaucccugucucuguuucccaagugcugcauuauggcauguggacucugcccagcucauuuggaugaguaugauuuuacuuuuuuuaugcuuuuuccccccaaagcucuuaauaaagagcuuucauacuucauuaauaaauguuuucaugcuucauuuuuuucaauaaauugagcucaaggacuugugcaugucagguaaacauucuagcacugagccauauugccaucauccucuguuuguauauuacuaaaauuauuuguuaugauacuaguacugguuauaccagagcuugaagagaauauugaaaagaagaaguagaagaacaaacuauauucuuuuuugacuuccagauuucagaaguugagaguauauuauuauuaaggcuuuuuaaaauucucaaucaucaaguugaaaauguguugguagaggcauuuguaauuucagagaaagauacagucccagggugguauaguauaauugcagaugccauuuaaccugucaucuuauugucuuuuggagccucaauuaccucauuagaauaauucagauauuuauuugguccuuggcauuuuccaggagcugagcucaggucuaaaagcagccucucauaggcuugcuguguagguucaauuagguggucaagaacuugccgaggggcauugcuuguuauuguuggcugccuuccuuccucccaugcaagaaguguaguuuuuccauaguuggacaugaagacaguaacaauaaauaaagcacaguuuuugccauugggcaguucuuuuuagucuuagcuccuagguuugagcaggucacuguguccucugugugaggaaaaaauagcacuuaauaguauggcuguugaaauuuggagacaguguuucauacagucugaggcaggaaggauaccucaugaaugauagcugggauugcucugcuccccacaccacuggcuucucacaccccugcugagucgcuccaucuaccgaccugcucacauucuuucccuuuuuuccaguugaaagaaaguauuuguuucaaaacuuuuuuuguuuuuuguuuuuuucgagacacuuuaccaaaucauuagcuccucugaguuaacugucaguugcaugauuggucgucccaccagugcugucacaauugcucugugauauuucuauucguguuguuuaugucacuuggcucccacacuaaagcauaaccuuucuccagacaguugugcaaucugucuauaguauguauggccaaaagcaaauuuagaaaggccucaauucaguaggaauguaaauaaaugaguauuucuuuggcgugugccaggguuuucuguaauaacucuuggugcugcuuauuucccagguauaucaaggagugaagaaacacggcuucuuacagccucauuuuuuggcagaacaagauauaguuaucauuaccuaugauguucuucguucagaacuaaacuaugucaauaucccacauagcaauagugaagaugggcgucgccugaggaaccagaagcgcuauauggccauucccagccccuugguagcgguggaaugguggaggaucugccuugaugaagcucagauggucgaguguccuacaguaaaaguaagagucuguacaucuuacgagugcagaggaaggacgugaauggaucaguaguugggauucaguuaagccacaguacugaugguguuggcacauuuguugcuaaauacucuuguguuauucuaauugucuggaugauaguuuuguauggacuacuuggauaucuguguguaugacacaguucaaagcaaacuaugcuuagggaacuuuaaaucuucucaccuaauuggaagguuaaucaaguguucuccaguagccuguagcaaauggcuaaaggaaauggcccuuacauauugauuuuuauuauagcuaucucuguguauauguauaccucaggcauuccucuguuacucuucacccuguuguuuaagauggucucucauuagaucuggaacuuacugaguuagccagcuagacuagcuggcuugccagacgcagugaucacccugccaucauuucccagugcuaggauuuaacugcuguugugcacguuucuuuguacuuuggugcuaaggauccaacuucagguccuaguauuguguagcaauuacuuuacugacugagcagucucccaagccccguuauuuaucuuuauaauaucuccagugaccaaucuguaaccugaacugcauugaugagucauaucuccuagcacaaacgcccaccucucuaguaccaagcggugaaggggguguauucauccaggguauuucuccuucucuaugugcuugagccagcccugcaucucuggcucaugagaccacugcguuggguaauggcuuauugagucugacauucagcagugagugugaagacucaugauuaaagcagauguaucuuaccugaaaugggcuauagugggccuuuuuuuuuuuuccugauuuuucgagaccggguuucucuguguagcccuggcuguccuggaacucacuuuguagaccaggcuggccucgaacucagaaaucuaccugccuuugccucccgagugcugggauuaaagguguacgccaccaugcccggcuagugggccauuuucaugaggaaacacacaccugaguucuguguuuuguuuuugcucauaauuuucuuucauuaggccgcggaaauggcccagcguuugagcgggauuaaucgguggugcaucaguggcacuccaguucagagaggauuggaagguagguaauacaggcuuuccacggccaccauccuugaggagcuuacguacggggaaaaguacugcugugcuugaucuuugucagaaucuuuaguaaguguauuuucacuuagaguuugcucuuuauaguuuaaaacaauuaacuuguaaauggaacgugggugaugcuucaguuuguuuucuugaggucagauacauagugaggacucccauugcuuuaaauuggccaaguguuguuggacccauuccacagaauagcuauaggucucaacucaaccugaguuccaaagguuuaaaccugagaagaaaggaaagcaugagggagagaaaaauuucaucuaagggacgcugaagaaaaugacagcugaguugagcucugcagcgcugcuaagugaugggagaggcaaggguucucugaaguagaggagccugacacuugaagguaauaauacugcaggagaccuuaaacaagugucaguguggcuagagaacaagagccagggcaaucauucuugaguggauagacagagagaaaaccaaaauagaccuauuagacaccauaggaaaguacuuuucuuauucuuuuggaaaaacagauuuugaauuuugaaaauuugggaaguuuuugaaaacuuggaaacuauuagaaggauuuagauacaauguaauagauuaaucuuguaaaugaauuuauuuuucaaaagaugacugucauuguaacagagaaugauuugucagagagcagagucuauaguaggauaucagcuguuuggcugcagcaauuaauggaggcaggcaaugcuagcucugugggucuagacuagaguuguccuagagaaacagagaaaguggacgaggaaaauuaacaaguugcagugugcugauaaauuucuaagucauacacaucugugaauuaugcuagaagaaaagcaucuuuagguuguuaauuuguuuccagcagauauaauuagaggaccucggugaagcagaacuuaaacaauuggacugacgugaucugaacuauaaaucucugauuucugcagauaaaagugcauaauuccuaugugcugcuaccagagucacuugauucagcuacauagcaaggcccugucuaaacaguaauuaaaaccuaaaauguuugcuggccguccucaaaugguggaauagguaguuuauuuguuucacaguuuuauuaguuccuuuagagucaugcaauguauucugaucauauucaccugccuccccuauuucuucucaguucacucacccaccuagguuuuaauccuucaagacaaguuugugcucccaaauauuuggggguauguggucuugcacuagagaguuguugacuucacgaggucugcucucccuuucccaggagguaaugauacccaauggcuccagggauuguguuuccaacuccccucuccaugaugggauuuucucuggcuggaaaucaugaaauuuuaaaaaauaauuuuuauuccuuuugaagagagcauauauuguguuuuuuuuuucaacuaaugauacauaaaagcauaaagaaaauuucacucagacauggagaaauggcacagugguuaagaguggugauucacuaaguuuuguguguacuucauuauugucuuacacuaguucccuagaaaugaaguuaguagugaaagaucaucagagauguuaggucagagcauauucucugaaucauacgaaauuagcugcuacuuuuguuuuuucauguucuucuccuuuaacaagucuugcuuuaaugcacgugucuuaacacagcaaaucacugacguucacugaugguuuuugaguaaagugcaagguuuugcgguaguucuuacaucuuagguaucccagaaauuaaagcagaaccuagagcacaguagauucucaaaaauguaaauugaucugggauaaaaugugcacauucaagaagcuacaagaugcacccuacuucauggugaguccugucucuuugugguuugugagugagcuuaugcagagacaaaauaaauccagaaacauuuagcccuguguccugugacuuuuccuuuacagaucuuuuugggcugguggucuuucuuggaauugaaccuuauugugucaaacacugguggauucggcuucucuaucauccauacugcaagaaaaauccucagcaccuguacaguuuuauugccaagauaauguggaggucugcaaagaaagaugucauugaccaagucaguaugccaaacuuucauugacuauaacaaauguuuuacggaaacaaagcugcaaugaaguuaaaauuccaggcuaaauuguuugcaacuucccaauacagauccagauuccaccucagacugaagaaaugcacuggcuccauuuuuccccgguggagaggcauuucuaucaccgccagcacgaggugugcugccaggaugccauagugaagcucaggaagaucucugacugggcccugaagcucagcagcuuggacaggagaacugucuccuccauccucuacccacugcugaggcuccggcaggccugcugccauccacaggcuguucguggggaauucuugccacuccagaagagguguuaccaccaacucacuucucuugugggauuuuuggugcaguagugggcaguauuuaggcacuuuugacucccaguuugauucagggauuucuggcuagguagcaguuaaauuaguaguaguaguaguaguuguuguuguuguuucaugguuuugugucuguggagccucauuuguaaaagagucauaaaaauuguuuucauuucuuuuaaaauuuaaacuuuuauaacagguuuugugguuguauuuuuggcuuagagaggauucuucacauguauuuuuaugcuuucaagacaggguuuuucucuguggcccuggcugcccuaguacucuguguagaccaggcuggucucugccucccaaguacuggguuaaaggcaggcacccccacaccuggugaaaaauuuugcucuuaauaauacgucuaguuuuccacaugagggaugugcuagcuguaaucuuugaugugucuuguuccauaauucuuuuuguggauuggacuaaaccuuaaaagggggcccguguuuaguaccugguauuauaagaagcucucuugucugucaaagggcuguaaagaugggggcuuaacuuuugaguauauuaaagacagaaauagcaaaggugauaaauucauacaauauaagcugaaugugauaaaagcuuuacagauuauagauugcuguggaaauaguuucuauuuaaguaguuuaagacaucucucuaguggaaauaacauccgacuugacuacuagaacaucucauuuuuuauuuuauaaacuaaaauuugaauuuacaguaaaguauaagucuaauuaauuuguagagaugugguucuaaauaaacccaguccuacauuguaaucuuuguacuauuucaaguagaucauauuguucauuuucaauaaauguaaaagaaagcagaucaaguaggagaauacuugcuggauuaguaacaauuaaguauaagccauaacuaaaacugaaagggaagggagugguucagcaggucagagcccuugcuguucuaccaaggacugagugcagucccaguacaauaucagguuuuuuacaacacccuaaaacucuggucugugugcacgugcauacucauccucucucucucucucucucucucccucucucucucucucucucucucucucucacacacacacacaaauacaugcacaucguacucagaugcucacauacucauaaauacauuuuuaagaguggagaugaaagcugcugaaggugugauauaaaugcuauagagcacugcacccugacauuccagcaugcugacuuuccugcugagguaaugcuaggagguuucaauucugguuuugaaagcuguuucuucuuuuagcaccaugacaauggaagaguugcugacaucucugcagaagaaauguggaacggaaugugaagaggcccaccgacaacuaguuugugcccuuaacggcuuagcaggcauucacaucauuaaagguagaaggugauugcuuuauuauauuugauucuuccaguacuugcugaggaagguuaauuacagaaugaugcucucacacacuacugcuaugaguuuaauggguuccauuacauagcaaggacuuaugcagaacaugucuagaacaaucaguguacauguaccuuaagcaaacauuuuuaccuugagaagauuaguaaauuggaaaauuuuaggaaauuaagacaugaacaaauauucucccacaagauauuuaucuuagucuuuuauagugaaaaauuaaaaacaggcagaaaacuuagaaauagaaaaaugauuaaauuguaauacauacuuggacauacguauuuuuaauugauuuuaaaauugauauuguacauucaguuuuuauaucagagugugugccaagaaugguccagaaagaacaugcaaaauaaaaucucaaaucuuucauauacaacuaaaaccacaguuucuaaauaaucacaauaauugauagacuuauuaugaggauaggcaaaucuauaauuguaguagcagguguugcuaucccuuaccaacugcagaacaagcagcuauuguugugucuugggugaaagugguguagucagcacucacugaacacugcccagccccagaggaaugugugcucucuucaaguacacaucuaaaguaugaacaagucaguaagucuaagguuuaagucuuccagugcuuguuuuauuaccacaguggaauuaccccagcuaucagguugcugagggaacuccugccaagcuugaugauaugagcucagucccuggcacccagcuucuggauggagagaacccacaaguuaaccucagugugcacugugccaugcacccccuccugcuucauaaguaaauaaauguaauuaaaaaauagauaccaauaaaaaguaacuagaaaugcuuucacauauuugagggagggaguaauaguauaaaggguaauucaaaagagaagcuaggaaguauuuagaagugaaugagaacaaaauaucaagauaugugagguccuacauaucaauaaauaagagguuuuuuuuguuuuuugggguuuuuuuuguuguuguuguuuucgagacaguguuucucuguguaguccuggauguccuggaacucacuuuguagaacaggcuggcuccgaacucagaaauacugccuccgagugcugggauuaaaggugugugccaccacugccuggcaaauuaagggaaauuugaagcagaaaauauuuuuagccaggugugguggugcacgccuuuaaucccagcacuugggaggcagaggcaggcggauuucucaguucaaggccagccuggucuacaggcagaaugaguccaggacagccagggcuacacagagaaacccugucucgaaaaacaaaacaaacauaaauaaauaaauaaauauuuuaaauauguuuauaguucuauuacaucuguuccguuaauuuauaaauuuagcuuuaucauaggauuaugugcauaagaaacuaugcauugggcuugcacuguacacuaucaugcauuuaugcuugcugguggugucuuuguuuauagcccuugcuaaugagucuaaauuugcuucaagguguguuggagggagggagccaccuugugauaaauagcauuuccaucagucguccacauguaacccuccucugcaccauccagcaccaugagaguuacuauuagucuacuuugaugugcagucaugggucauuuuauagcugcucucauuuacauaacaacuuaaaacaucauuuaaaggccuggagugguaaagcuccuggccuugaaagcauggagaucugaguuuaauuccccuaaacaugcuuaaaagaacccgucugcugguguuggugcacccuuguaauccagcauugaggagacaggccaucuagccuagcuccuggggaacaucaggccagugaaaagaugcugucucuaaaaauaacaguaccugagccacagcagccaccugacauugucauucgggcuccauacacaucuguauacacaugcacguccaucacacagacucaugaacuugcacgcucauguacaacaacagaagacugcuuguucagagacauauguaguuucuguagaguacaaaauaagccuucuaagccuccaaguagccuuugcuaucuguuccuuggcauggcagaaccgcccuggguagugugucuuccuuugcaggaugcuugaggagcacuagagcaagccauucaaacuggguagaagcagcucugguagggcagaaagauggcuggccucugacauccagcacgucuaugucuguccuucagagcacagcauagaguagcccuugcuuugccucccccagaaaguaagugucauucuuaguaugaaacagggaaacacuggaaacuuggaaaccagaucuuccucauguuauggacuguaauauggagugaccucagauacucugaguuaaccuugcucacaguguaaguuuuauuagcaaugauuaacagaacaaaaauauggguuuagagugggucugauaaguuuuucaaauauggcaccuacaacuuuaacagaaguuuccuuuugggacaggcucuuuuaaguaauaguacuuacgaauuuacauugccuauguuuuuaaccauuuugguaaguguucucuguaguaguaguuguccagggauuaaaauuaccugggccuuauagucuguuaaaagacugaauagguaagcaacucugguaaagaauuuuacaguugaacuuuauuucauaccaacuuggacaaaauuaagcaaaaauugggaaaauguguaucacaucuaauaccagccuuuuacagucucaacuuaauugacuagaguaacugugauuagaguuuauagauuacuugacuacuacaaauaaaaaauauggccggacgugauggcacacaccuuuaaacccagcacucgggaggcagaggcaggcggauuucugaguucgagaccaaccuggucuacaguuguccuggucuacagugaguuccaggacagccagggcuacacagagaaacccugucuggaaaaaccaaaaggaaaaaaaaaaauaugcuuuccuuugaaaaugugugaauaaugaauguaaugaaaauacuuuguggucauuaaagucuaucauccugucuaagaaaugguauccuucaaccccuaaaguaggucucuauaauccaggcaggccuugaacuuggcugugugaccuuggcugaacucaaacauguguucuuucuucaccccaagucacauuugcauuacagcuagaagugaucuuuuucuuuuuuuuucuuuuucuuuuccuuuuuuucuuuuuuuuugggggggggggacuucugcggcuuuuauuuuugcauguaaaccacuuuggaggggggcuugauggugggcacccuagagauuacacuggaguucccagggcuccagacacuagccgggaagucagggugaucuuuuucuauaucuauuuuauauuauguguaggaguuuuaugacugcacuauuuuauuugcaugacugcuuagugauuagaauauuacuccauuuugcuuaaugaaacauucacauggcuuaguugcuuucccaacacugcuaaugccucacaugguguacacaugccugcuaucccagcacuugggauucagaauaucugccacagaauuuguguguucuagugcuggguuacagacauguaccaucccaccuaccucccucuucauuuuauguuguuguaacaugcucugacaagaaguggaucucugucccugggcuuuuaucuugucucccucuuggauugauugcuucuuuucccugcuccgauguuaggguugggguagaaucuuguuugcuccuuuucaggcggucaggcucuggcaggacgaaugugucgguuccugccggacaagcugcacugcugaucugugcucugugugugugguuccacugcacucccccucuggucuccugucuguaggugggauuacagggcugagugcugcuuagacuguuuauguauggaucagucaguaaggacucaacuucgaaaagaaaucuacauuuucaaauucuggaaacacuuucuuauaguauggaaaugugugauagauaacgaauacuuucagauccucagugacugguauuuuaaacacaugguauuccggguuuaagcaccaugcuaucuacagauaaucuuuagaaguaaaugaguuuggaauucucaagucuauugaaguaacuuggaaguguuagugccaucaaguggcugaaaauguguauuuccaaauuuggcuuuggcuuguauuuguaaaacuuguuguguauacauauuuugaguuuuccacagacaguguauuucuagaaacaugaaucagaugcuauaaugaaucauuccugaucagcugcuuaaauuauggucuaagccacaaugcuuccuuuaaauggaaauuuauuaaaugauuguuuuuuauaaauagauacuaauuguguccauaugucugaaugccauuucagucuaagcaccacaaaaguuggagcauaaaaaugggaauucaagguuaauugagguuaaauagguagauccuguuucaaaaaaacaauucacugcauaaagauaauugaauauuacuccucauuauauuaggugacuuauuuuucugaaaaucauuuucuccaauauagaacugaauaaaaauuaguugaguccucaguauugugaaaguauguauuuuagaaugcuuucuauuauguguauguauaugggaauauauguauuuacauauauacauguacauauauuugaauuuaggugaaagaagagaggcaaauuuacagaaguguacauaucuauauagaaaacugauuuuaguuauaaauauaacccuaaguaaggauuacuuuaaagaauaacauaccucuuggcagagagacagcaacaucucugcaccuucuuuguauuucauagcuuuucugacauaccauuuuaaauuucacuuauaauguacuaguuuugagauuuucuccagagagcaagaguagaugcuuuauucuagcuaugaaccaugacuccucuccuuccugccggugucaccacccuucuuuauaguaagcagacaagaccuugcagcucugugagccacagggguccccagcauccacugggcccugcuugugcaaugcagaagcagcugcagacagcacaggagugagcggagcugggcuccaguacaccuuuauuuaugguuguugaauuucucauguuguaaaacauaugcacucuuaaaacauguaaaacuaggcuugcuauguagcucagugacaguuugcuuaccugucuggcuuacauagagccuaauuuuaaucuccagcacucaaauaauaaaaauauaaagccauucuaaacugagaaauuauauaaagauccagaaggucagauuugacgcgcaggcgaaugccuggcagucugugcuucccgagauacuguucgaagugugaguccucuuaaguacaaacgggaaacugcguaagcgugagcugcuggugguggugugaucagaagugcaaguacugcuaagguugugccugcuuucuguaugguucccuuguuuuguucuugagauggggauugacucuaguccaguuggccugcagcuugcuguguagugcaggcuggccucaaagacccagcgucgucccucauagugcuaacauuacagacagcucuugguuuuugaaguguuguuuuuaaaaauuauuucgucauuuuugagaugauaacaguuacgccauuucccuccuccuucuaaacccuccuaucuacuucuccuugcucaugcucaaaauucauugcuucuuuuuuucauuaauuguuguugcaugcauauguguauaugcuuacacaauauauacuuaacuauagcguucucaguauguguauuguugcuuguauauugguucucagggcugccuauauccuacccagugauggacucuucccugggggagaccaguucuccaccuccagugcugcugcucuaguucuuugugugggaaugaagucuccuagucuucccucccacccauuuggccuauuacuguuguucuuguuuagcuuauauguuucuaauugaaaauuauuuaugccuuauaccaggaacaaauauguaugucaauaaaaguuuauuauuuuucugaaaauuagauguagauugaccagagugucaugaauacuucuuuauuacugucgaugaccaaaauuugucuuaaccuuaagucauaaugaaugcuaauuggcaaccuuuaugucuaauaacaguaagguuauuuucuaagcuuauuuuuucaguaugaguuuaagucauucuaaguauacuuuauuccaaauuuaucucuauaauuugaaacacuaaaauauccugugaaauaaaggaaccauaaucaccuuuaaaaaaaaaaaagacaggaguaaucguguaugaggucagauucuuuaguaagauacguaucugagaguauuaccgugguggugaggcugcugugcagcauguguaaagccccgaauucaucccggcacugaagaaucaauaauaauaaccauaguaagagguaaaguuguuauuuuuguaguaagacuuuuuagauuaaagguaacuggcuaacacugggaguacugcgacguguguccuuucucugcaggugaauaugccuuggcagcggagcucuacagagaaguauuacguucaucugaggagcacaaaggaaaacucaaaacugauucccuucaagugaguguagccugaaaaaguucaaguacauauucaaauuguucuaaacaacacuuuucaacauguuaauguuaaaauaaaggguuacaaugaacugagucagaauacuagagagguaaaagcaggcauuccuuuuuacuauugucuugaaugauuugaguaauagaguuugaaaaucaacauuauucucuauggaggccuauagccuacacugggagauaguuuucauuaucuguaauucagagaguaggcuaauuuuauaauuuuucauuugacuucaacauguuuguuaaauagcuuucaucaaaaugaaaaaaaguuagcuaaacuaaguaaacugacuaaauaaacacacuaaauaaaccugaccuuuuugaucuucugugcuagacucucagaggccuuuuagaaagagauguauguuugaauuauaacaguaacuguguuuccagcagauuauagguaagacuccagcaaaguaagaagugaagacauaggcauuaaacuugguaggccuggguugcuaccuagggaaguugacuuuucaggcuuuagaucuuaacaucgccaugugauacaguggccauuuagaaaggaguaaagagccgggcaugguggcauaagccuuugaucccagcacucgggaggcagaggcaggcggauuucugaguucgaggccagcuuggucuacagagugaguuccaggacagccagggcaacacagagaaacccugucucggacaaaaaaaaaaaaaaaaaaagcagaaaggaguaaagaaggacaggauuguagcaaagcuuagcugagcagcaaggccuuaaacagugaccuuaaacacaugugaguaccuaacaggaaaguuguucugcucuugaaaaaaaggaaauaaagaugcaagaggggcaaggagauagauuugaguaccaaaauuuugaauucaauauccaaagaggaaugaucaguuugguucuugcuuuucauuaguucaucucugcggacaagcaggguggugcucacugaaugcuuacucgguccagucagcucagcacuucucuuccccucuaacaacaugugaaaaaacugaaaacucaucuuccacaaguauacacagagaagcugaaacacauaucucuagcaucauuuguacauuuuuacuauuaaaucuauuauuacuaugcacugugugauuugagaagccauguugaaaauugucaagacauuugaaguaauguagacuccauagagacuuaacacuauagcuaguaauuuaugcccggauagaaugaaucccgaaagucucaaaucauauuuuggcaccaaaucauauuuggccagaauucucuccuaauaaucuugaggcccuagcuaucuucucggguaaaauauaaauuuaagagugaaacugugauuucauuucaggucuauucauugcuucuaaccuuuagcaaguugcugacucagcaucagggcgggaaguagguagaugcauucacacagaaauaaagagguuuuucucuuccucugaucucuucaacuccaacuuucccucuuuucauacuuuaagcuugguguauucaaguauaccuauauacucugcuccugaguacagagcuguuguuguaaaugguaucaauuagcuccguuauuaauaugccccagccagccccucaguaauccuauugauuuauuuaaccaucuuagcacagcuacugguugauaaucccuagucuuauuuuccuaugcuaaauuugacuauuucccagcugcacucacucccaaguuacuugcuauuugagucucacccgggcugcuuuuguuucaucagucugucuucagggacacuucuuuuggccccguauugggcaccaauuaaugcgauuaauuaacucugcugguucuuaauaugaccugcacacacacacacacacacacacacacacacacacacacacacacacccgcccaauaauacauaguccuacuugauuuauuuaaucagcuuuaguacaauuacuaggccauuaucccuaaacuguuucuuuacacuaggcuggcuauuucccagcugugcuuuccaagugacuugcugguucgagucuugcccugguuauuucuacuccuucagucuguccuugggguauauuucuauggcccugugcuccugguccaucccaucuaauggaaaccucuuuguucucuuaucuucuuuguucuucucucucuccugugcucccuaccugagacuuccagccuaguaaccaaaaccccgccuaccucugucuccccagguauuggcuguagccaguuuuaauuggcaaucauaggagauuggcgagcaaaguuuauacaacaucauuugguguaugugagagucugcucauugggagugcagccagaucuuggagccaguuucuagcguuuggauacauagcagcuccaaaccaaucccuaacacguagccaugcuacagaaaaacauguauuuuuuuauuugaaaauaauccaugucauuaucauugaagacauuugauguccauuuuccuugguggugguggggcaauauuacucgaauauuuucaaaggaaaacuauuugacaauauaaauuuugacuucauucuguguagauucugcggugucugcugcauugcaucauagccuuaccuuuuaccuuuuguguguuuguaacagagacugcaugccacacauaacuuaauggagcuguugggagccaaacacccaggaauaccucccaccuugagagauggcagacuugaagaagagguaauuguuauucuuuuauuuauaaaaguuuacuuauagaaguaucuaguugaugcuucuaaugcauaacauuuaaauaaauguagccagccauguuuuccugugauuuaauguuccaaacauugcuguggugguuuggaauggcagagaaaguuggacucuauauuacuuuguuugccuggugaucuguuugcagauagguuagauggcuuguagauacaacauuauugauuuaacagaugaaaacauuuugauuucaugguaggacuauaaagaguauaguucaggaaacagaaacauuacagauguucucuuccuugcuguguuuucuuuaagagaguaaaugucucaaauucucaguucaaguuucucucacugaacagaauaauacuauaccuuauuuuaauagaaauuccucauagcuuguuauacuaagucuccccagaauauuugccuuuuuuaagaucaaagaaaaagaaagugaccauugagagaguagauaugguugaaguauauuaaacuucaaaguaggauuuuuauuggaaucagcaagauuaaaaaaauggauuugauaaauauauuuaacccuuuguauuuguuaaaaugaguaauuuuuauugacaaaauugcauacauuuauagaugcauacagauacuguggaaugggguggcuaacagcauaaauuauauauccccauuaucucaugagcuugguuuuuauaguaaaaauauuucacaucuacucugagcagcauacuguaacuagucauugugguauaacccuuugauguauugcaggaucccuaucucugcagucccuagcaaccaccauucucuauucgcaugaguuuuacuuuaagucccacaucugucugaggucaugcagcauuuauuuuucaaugcuucaauuauguuaauuaguauauuguccccuguguuuauauauagugucagaaauaacagaaauuuuuccuuuuugaaagcugaaggaugugucggguguguguguguguguguguguguguguguguguguguguguguguuuuaucacuuuuuuuccaacucuguaugugugugucaugcauaugugcaugcaggcucucauuuguugguagaugugugugcaugaauauggaggcccaagacugaugucaggagucauccuggaaggcucgcucuucugucucauucuuugaggcaauuucucucagucaaaaacagagcucauugauaaagauagucgugccagucaucuuguucagggaauccuuccuccaccuuccaaggcuagauuuaaaggcaagcuuucauguccacuggcaugcaugugaguucuggagaucugagcucuggucuucuaacuuguugggcaugcguuguaagcacugagcuaucucccuaccucuguacaccauauuuuuuaugaauguuuuuuuguucacuguucauuuaagaaggugaaagaguggcaauaacuuuuuauuccuguuaguuuuaguccacuaggaauaucauaacagaauacuaggcugugaggcuuaaagaauaaauauuucuuacaguuguagaagaugaaguccagagucagcaucuacauccucuggguuuaguuucucuucagccccuggcugggauuuagaugccacuguugcuuacugccuuccguuugcacuugcacaucccagggcuucuuuccuccuaaggccuccauucaccucaguuagcuugcaggccucucuccaggggccgucacauugagcuuaggacugguacauacaaauuuuguaggaauggguucacuucuaacaccuuuauuacuguguaacucaagaguuauuuuuaaacaauggcaguucuuaaaguacugcaacaacuaaagcagacaaggaauucuguaagaucucggcucacuggugacauguuaaugucuuuuuauccuauaaggaagaaaucuuuaggcuuuuuaaauuuuguggcuucagcauaccauuuuuucuuuugauuguuuauuuuaggaauuucuagaauauuuuuuauaauacaaaauucuauguuuguaucaaggaacuuuaacuauauggagcaaccacauuguuccugaaacacaauacuaaauuaugaucaagaucuugagugaaaguguuauugacuugcuaucuccacacaggccaagcagcugcgagagcacuauaugaguaaguguaacacagaaguugccgaagcccagcaagcuuugcagccugugcagcaguccauuagggagcuccaaaggaagguacgugucacccaguagcauuuuggaucuauuuauuuguguuuuguuugaacuuuuuguuucccuucaaauucuuagcaguuacuugagugacacagauaucuuaguugacuuuucuguugcuuucaccaaacaccuuuaccaagacaacuuaugcaaacaauugaauuauuuaauuggacuugguuucaaaggucagauggcagagcaaaggcacagagacugaaacagcugagagcucaugugucgucccccccaccccccuuggauacaauauuuuuauuacagcaacagaaaaguaacuaauucaucagacagaagauaaccauggagcauucacauuuauaguagaaaagcgacgcugccuguggccuggcccgagaaggaaagggagcagauccagggcugaugcuguggggcugcuggggcccgaggugcaggaaagaccguucauuucucaccaacgugggcaucuuguggcuccucagugcuguugccuuuacugucagaguucgagagcucaugucuugauccauuugugugaggcagacauagaaaguauccugggaaagcagagagucucuugaagcccaccugcgugacauaccuccuucaagccauaucuccuaaucuuugccacacacuucuaccaacuuggaaccuagaaugugagcauaauagcuugugcaggccauucucacugacacugccacaauaaguauauuuacaguuaauggugucuauuccuggaguggauggacuaguauguugaugagucugcuauauugaaaaucuggguuuuuuuuuuuuuauguuggauaaauaacaguuuauccuuuagagaaagacuuugguaaucucuuuuugaucuuagcaauauauguucccacauuuaggaucacagguauuauucuugcagacuagauaccuguccuuucugaguuucuuuuuuuguugacaccagagcaaaaucuaacaguaaacaacacaaguacguaggcuuuuacuucaaauguuuuaucaguuguuccccauguugugcuuccuaauucauuaauuacuugguaacaguuguacuuuuguuauguauuggguggaaucuaguucauugauuagaucuaaccuuucuuuaguguguuacccuuuacacuuagcuuuuauuuugguaaaaaucuuuuuaaaacagcuuugaaacacaaauuuuacauaaaauaucguucgucuagaguauuguuguuaugaauacaaagagguauuugcccaauacacacaguuuguguguuuuucugugugauauagauauauacaguaugcacacauuuaucaguuauaauccuuugagaacagaauuuaucaguauuuuuucauuuuuuguaucucuuuucccauugaaugcuaauauaugcaguaacuggucaguuuuggccuuuuuuuccagauucauucuaauucuccuugguggcugaauguaauccauagagcaauggaauuuucuguugaugaggaacuuguucagcgggugcgaaaugaaauaagcaguaacuacaagcaacaaacugacaagcugucuaugucagagaaguaaggcaauaaugcagaacugagucacuguguacaagcgugcaggucauuuaguaucaggagcugcaugcacuucagugucccgccauggacuuagggacaucugggguuuacagauauuaagucuaaaacagagaucuuuuuuucuucuguuagccauuugaaauguucuccuuuuagagccuugaggucucuucuuuguugcuguuguuguuuuauauguauucuuguugguuugaaauccagucucuaaguagcccuauccugaacucuuuauguagaccaugguguucuucaacucacagauccaucuggcacaugccucugccucucugccucucugccugccucuccaccucucucucucucucucucucucucucucucucucucucucucucucucucucucugccucucucucucucucucucucccucucucucucucucucucugccucucucugccucugccucucugugcugggauuaaaggcauguacaacgacauuuaacuuaauuacauuuuuauaacaagaaauaugacucuuauccauuuuucuccucaauuuuguuucagacuguauagucuacucucuuuaaauagaaaaagaaugucagaaaacuguagucaucuaaccuuagaaagcuagacuauauuaguccugaucuugaaagauacuguauccucucuguuaggucccaagaauagaauuaccaaacacacguugucaucuuuuuguaacaggcauugcauuuuauuaaaccuugaguacugguagguaccaguggguacacucuaaagggaagucucagcagagugugugaauuugacaguuucuuuaacagcaugauugacacacguuuucugaagaaacugacugacuuucuuugugcugugcugcugaugggaauaagguuccgugacugcagaggucuucaguucuuacuuacaacacaaauggaagagcuccauaaguuccagaagcuggugagggaggcugugaagaagcuggagaagccuccaucccgggaggugauugagucugcaacaguuugccaccugcggccagcuagacucccucucaacugguaggugucuguggaaguuagacaggggcccgcaugaucucagaaaugguuguucauaaguugaaccauuuuaccuuaauucagacagauguaaacauuuauuuuuuaaacuaaaacaaaccaaggaucaugugcuugaaaaccauuucauuguuuucuuaaaugcucuauuuguuagaaaaauaaaauacaaaaugcuggggauuuuuguguuuugggaauuuuuuuuuuuagaaauauguuauugugggucauauuuguaaauauuucucugauaaucucuuucagcugcgucuuuuguaaagcugaugaauuguucacagaguaugaaucaaagcuauuuuuuaacacguaaguucacugauuauuacucaugaggaaaaggaaacauuucaaaggauuaaagucuugaguaugugacugaauuuucuauuaugaccuuugguauauuuuuccuuuauuaaaucaauuuaauaauccuuugggauuuaacaugcccauuuuuuucuccauagaagcuacaccuaaauguuuauaagagacagucuguaauuauuguaauugagaagcaauugagaguaguaguaagauccuaaacucaauacuuugaugaauuugaacucaaaucccugaacacugucaagagcaaauuaccucuuuaaccaugaagugaagguaauaacuuaaucuacaauuaaguauuaaauaagaaaaaaaauacauauauacacauauauguguauguauauauauacguuuaggagaaugcuaguacauacuaaauaaccaauaaaaaauugaaguucuuguuaauuucuucaucagaaaacuuaugcuguguugggauuguuguacuuggcaugucuguguccugauuguggccuuugcucuguugccacugugucuuuucuuugguuuuuaaugccugguaauugugguugcucaggauucuuagaauguaauuuguagaaugagauuuaaaggguuuuguuuuuguuguuguuaucagggauugagcucauggaguacaaaaacaggcacauguaaucuuuuuuuuuuuuuuuuuuuuuuuuuugaucuuuaccuuugaaaguuggaggaaggacaguaaggcguugaaggccagucucugcuacauagugacuaggaggcuagucugaacuacaugagacucugccucaaaaauauaaaacaaaacaaaaauggaaguacaagacaguuuucaggauuacuauuuuuuucagggaccuacaaaugcucuaacuaacaugaaaauugcuguagaguacugaacuggcuuuucuguguuuccugcucgccucgcucauuugcagugcuaguuagcaggcagcaguuagaauuacuuguuucugauauuuuuucagagucaaaggccagacugcaaucuuugaagaaaugauagaagaugaagaaggacuuguagaugauagaguaccuaccacuaccagaggucugugggccguaagugagacggagcgaucuaugaaagcaauauuaucauuugcaagaucacauagguuugauguugaauauguagaugaaggaaguguuucaauggaucucuuugaggcauggaagaaggaauauaagguacacuauuuuuaaacuucugaaauuaaaaaccuuuuugcauuaacuugaaaaucugcuuuggagacugugugucuugugucuuucucuuuauuaaauuaguaaaaaaguuauuaagcugacacuugcaguuaaaauguaaaaauauuuaauuguauguuuuauuguaagcugcuuauucuuaacagcugcuuuuugaaacuagcauuugaauuuauuuugauuuugcaaugggaaauagcaaccaaaugucaguauuuacaugggaagcauuguaaauaucucaaguuggaaaucuggaaagcaucgcaauggauauagcauaacuuggccuuuaguuuucuucuuaagugguuccauugcauucuaaugugugagauguacaucuuuuuuuauuaaaucaguuucauauuuguuguauuuugaucuuugcguaugagauggguaugggagauagaauaccuuuacaguguaauaucaaauuuguauauugauauuuuuguaauuuuuuaaaaacaaaauaaaaaguuuuguguugagaagauaccuugucuaaaaugccaguucagacauuuuugaggaaugaugcuuuuauaaaggugaacucauuaguccaucguauuuguuauaaaggcaaugcacaugcacaguguucuguacagugcccugccuucccuguaguuuucucuauccugugcucaccaugugcucugggcuuaggugagugcuuaucaugccucucuccaucuuugugcaucuuuccuuuauaccuuugcacaagaaauggaaaaccaaugagcuacuacuagauguaucaacuaguaucugcuuuaaaaugugauagugaagacagcuuaucaaaauauauauagugauugguagcauuuuuauaaguuucaaaacucuuauguaacuuagcauuuuuccagugaaaagugggauuaaaaguaauugccugcuugacuuugaaggagaaagaauaaggaaagaaugauaauauuacagcuuucuaaggaauuugucuuauuaagucucuugaauuggauagucuauggucaauuauuucaaaaaucuauuugcaaauuauuuugaauaucucuugaauuagguaguuuauucaguuauuucagaaaucucaaauuuguaaauuauuuugaauaugugaauauaauauaaaaauguuuuaagccaaaaacaaagugguaaucacauaaaucuaguauugguuuauguagauuuuugucucccaugaaauacuuagguguucuguuccugagaacugcagcagcauacaagguaguuuucucauacauccucauucuaaauuagccugaagaauugcuuuuccuugaagauuaaugaaaacauguaggccucuuugaagccuuuugcucaaaguacaucuuagugauuuuggacaauuuuaaucuuauuucuugcuacugucuuuauguuuccccaucaguuacuucaugaauacuggaugacucugagaaaucguguaucugcuguugaugaacuugcaauggcuacagagcgacuaagagugcgccaucccaaagagccaaagccaaacccacccguccaucacaucauugaaccacacgagguaguugagaaucgaucacaagaaaggccccaacaaaaauccaaaauauauaacagacauaaagccaaagcagcgaugucuucuaguaauaguuacugucauaaaaaugggcaauuucauucauaugugauacaugcuuaguguguccacuauuuggguacauuuuguuugcauauucuucuauuuuugaauacuuuauauacaucaaaucaaauagauauccuuggucacuuuuagaaggauuuuauagccucaguuuuaccagaauuugaaaaaacauguuucuuagaaguaacuaauaacuuugauuuuugcacguuuuuccgucuugcuaauagguauuuagaauguguacucuaauaaucuccauucgugucaggauucagucagaauucuaccagucuuuccuguaacaaaaauauugccuguguaauuuauuuuuaaccuuuauggauauuuaauacuuaaaccgauuucuuuuuguaaagcauuuagacuaugguuuaagauaauuuuuauguuauauacuaucuuaacuauaaauugguagagauguuuuucuuuuucuguuguguuuguuuguuuggagacaggguuucucuguguagcccuggcuguccuguaacucacucuguagaccaggcuggccucaaaaucagaaaucugccugccucugccucccaagugcugggauuaaaggcgugugccaccacugccuggcgauguuuuucuugaaacguauguuuuggacuaaguuuacagcacuaggaacauaagaaguaauaaaaaggaaaucccuucuauuuauuucucuuucugucugauguauugcagaagaggaagaacagucagggguagugucuccauaugauaaaccacucacaccaagcaguguguugugucauugucuucaucccacgcuuguauuagugaaaaguggcacagaaauagaauucagagggauuuuuauccgauuuccuauauaucaugaggcuucuuuuuaaaagaacuuuauggaagucugacuucagcuuuaaaaaaaaaguccuuucaaacuauauuuucaguauuaaucuuguaaaauuaaguuuuaauguauaaaugguauuucauaggacggggcgugaauuugauuauucagaaaaaucauacauguuuaacauaguugacccaucuuuuugagagggaauaaaggguugguuuguuucuagguugaacagaaucguauaaaacuggugaaugauaaagcuguugcuacaucacagcuucagaagaaacuuggacagcuucuuuaccuaacgaauuuggagaagguauagcuuuuaaaauuauguuuucccuauacuguauuucaagaaacacuuuagugguaauuuccacuuacaauuccagcccugcaaugaauaguacaggcuguguguuaguguuggaugaaucaagacuacuacugccugcaauaguuaugcagaccgucugcuaaacccucaguucagccucugcccucccugccuagguagauacgcuaccaaccgccaugaccacgacucguucugucuccacagccaucuaucccucagcccagcccagccaggaaaguaccuggaugaccugcaaauuaugaaaaauauaugauuaauuauuuuuaagcacuauguuguaggugguuuguuuuaugugaucugaaacagaucaauacuaagaugaacuaauuuauuaaacucuuuuaaaugacuguauaagcaaauuucuggaucuuuauagguacugaauuuaaguucugguuuuuuaucacuacuuagaaguuaaaggguuuuuugguuuugguuuuugguucuuuuaguguuagaauauuuaguuagugaaauuagaaagaaaaucucuaguuuucuccaguuuuaaagguugucuaccuugcugacuaucugaaacucuuuaaaauuuuaugagaauuuuaaggagguguuugaaaaaucuauuauaauuugauacaguucuauacacagacguuucaaaucaaucguauaucugcuucccaguuauuuguuuaguuagauuaaaccagggaugcugaguggcaacacuauuaaaacagaauugugccaaaucacagccuuucccaugccugaucuugggcuacauaugcaugaggguacacuuguacuauaauagcuaagaagcuguuuguuucuaagcucuaaauuuaaaguguuuuuuaaggucuucuuuuuuccagcaacaaaaagagaaagggucucauguagucagagcucccucaagacuaccuucaagauuaccccugauuuauuugcuucuaucuuccaagugcuaggauuacaguucugugucaccauaacaguuaguaauuuguauguauuuacaauaaagcauagucuugagaauaaacuuucaaaaauuaguucauauuuugauuuuaaauuuacuuucuauuguaauuacaaguauaguagcauaacacuauaagcugugguuuaaaaaaaaaauugguuuuccuuucuuuaauugugugcugaauaaauuccagaaauaguaauaguaguauuagguaacauguacaauauuaggugaucucacuaguuagauaauucagguugaaauuacaagcauauacccuacaaaugaauuucacagcaugcaucaaauccuaaauauaaaacauagcuaacauguuuuuugaucuuuuuuuccuauagucucaagauaaaacaucaggagguauuaauccagagccuuguccaaucugugcucgacagcugggaaaacagguaagguuauaauaaaacaucacaggaauccauaaaacaccuuacaauguauacuguuucuacaucuagccaggcuuucuuugucuugugcauguauacaaauauauacacuuucucauaacuguuagagguagggucaaggcuuaguuaacaugcuuaagguuacaaauauauaaacuuuuuccuaacuaaaaacuuaacccuagaacaaccaaccauaccuuuuucauuaaagaugcauaguuguaaacauuucuaaacaagacauuaauuuugccacauuaacauuugguaauugaacaaaguauaacauacuacaaauuuacuaguacagagacagugauguaguuccuaacaacaguaaagucucagaucuuaucuuuaaaguacagauaccgccuccaaccagaauuacagagaaagauauucucaaaagagacuguaaaucuuaauaggaaagcugcuauauuaauuauugagcagcagaauaaaaguauauaauaguguauaaugucugauuuaaguaaaaacaacacuauuaaggaagggauugggccuuagaguucuuuagugauuuugugugugccuaucauguaguuagcccugggucagggcuuuuauaaaguuccaugcuguagggccucuguguccuacauuucugcugcuacuguuagagaugcugccacuuguucucagagucuguuuacugaaugccucguuauugcugcuguucagucauuucuuccuguugugagaaaagguggaccagucuugcucuguaccuuaugaacugaauuccugugaaaagagaaaguccuauccuacauuuccagugucauuugaggugcacaggguacucaguaguguugcucugcgaagcaaacuugaaugggacuaaagggucugaagaucccgguuucagccuuugcuuacaugggugaaacuagggagcugcaagaaagguguccccaacuggaacaaaaugaacuuuccucauaaacuauuucaaagccacacuguuaccccaauuucuccugccccuaaucugaaaucuuuuuaaggagauuccuggacacauugcagaguucugucugucccuuucagugcaaauacagauguguccaaauccaggaaaaaauaagcugagagccuaaaacccauugccacaaagcagcaaacuuaagacaaaugaucucacaaaaggguccacaaaaaauuucuugugucuuuccaaacaaaucugaaauaucgucuuauuuucugaauaaguguguuagcaagugaaacuguaaguauguuaauaaguuaaguagcaaugaguauauuaccuucacauuaauguucucaguucugcauuaucugcuguuaaguacugaagguguaaucaguacugauguuuucuuuaaaucugaaaugagaacacuagcuucuuacaaaauaaugauaguugacuauuaaggaaaaugaagaugaaaauguaauucucuuagacuaaaaauaucuuaccaugagguacuuaggaauuggaguuguaaguccucuuugccuguguauguguucauggacaggaaggucucauugacccguucucaccaugacuugccaugcaugguuuuuuuucagugggcagugcugaccugcggacacugcuucuguaaugaaugcacuucgauuauaauugaacaguacaguguggggucucaucgaaguuccaucaagugugcuaucugccgccagaccacaucacacaaagaagucuccuaugucuucaccucagagaaggcaaaccaagaggaugauaucccugugaagguaugguaagucaagaacauacacaauuaaagcagugcaugccaagugaagcauuaaagacaguuggcacagugagcguagaaaccacuguugaguauauccacaguagcuggagacucagcuuuaucaccugcuccuuguggagagagcuaacuaauacagucagccgcagucauaucacuaagagcugaagaacugcauuucccugcccuguaugcugcuucucgucacuacagucaguuucagacuaggaagagaccucagugcuagaauacuuggcuagcuugcccaagaugcggugucuacuauuuaacauugaaaaagguuuuugguuuuuuuaauccaaauauguaguuguuaaaguuauuuuguuuguuuguuuugcuuuguuuuuuuuuaagcuuucuacuuacuuagucuaagccaggaaaaaauggguuccuagcauuagcugauuaucccaaagacaacacaguguucuuuaaaacuguguacugacauuucagaauacagagaaacuugaauuuguauugacuuuuucauguuuuauucaaaauaaaaauuuacuaauucagcauacaaauaggauccacuggacuuucuaccccaaauguguucauuuauaaaaaaaacacuagguguuuuuauuuuuuauuuuucuuacaugugcuuuuaaauuucuuuucuaaucagacuuggucaaaagguaaauuaauaugucauuuaauaggcacuaggggcuagcuguauagaguaggcagcggugguacuaaugcuuaagcaggaagaggacucauccucagauuccuugacauucuuauauuuuaagaauguguuuucugaguagauuugagaacaaguugaaauuacugacagagguagguauuuguuagaguguucucccuccuaagaaaccaacagguaaguuagaagauugguagcugcuuuuugaguaaauuuaaagugucagucacauugcuguccccagaguuggaaugaauuuccauucauuccuuccaugcauacuuauuagaugcuuccuaugcccaggcagugagcggccuugcagauguaauacacagucaagauguggcugcugaucucucugagguuacaguuuggugguaggaauggagaggaguuugaguuacagcaaaaaguaaagacauuaaacaaugauuuuuuuaaauuauaaauauuauaaaauuaaagccaaucugagcuuuucugaggaaaugauuguuaagaaacacaauguaaaaaaugaguggauuguccaacauggaaagaagguagaacugaucuugccaagaggauguucccagacugaaaaagaacucacaauaugugaucagaccaagacagacaagccuaacacagaagugaguggcugcagagcaguagcaaaacugaaaauaaaauggaaaggcaggcaaggcaggcacucaggcucuaaaccuugccaagaucuuccuugcuacaaugaagaaaaucaguuagcaaaagaaaaagaaacaagaacaaaaguggaaaaaauguagguguguuuagggggccacacaguuggcuaagauguauuuaggguggagacaguggaguuggaaagagguagguauguucaagggccacuaauguaacugagcauuagcagguauagcagggaaauacccugaauucugaugugaaaaaucagauaaaccaagacuuguaacuagaggcaaguguagaaaguaaguucucuguuguuucauuguauucaagauaaaagauucuaaagcaugcuuaagcuccaauaaaagacuagacaggagucagugagaggacucagcaggcagaggaacgugcugccuagcccaacaaccugaguucuuuucugagaccuauaugguggaaggagaggacacccaaaguuguccucugaccauaugcacacuguggugugugugugugugcacacaugcacacacaaaaauaaaaggguaaccugaagauacaggaaagaaaacuaaacuguaguauuagacccuuggaaaaaaauagaguauuagcuuauaaaaaguagagaucucauugaauucaaauaguuauagguugagcuguugagcaaacaaacuguaaguguguguguaucuuuaucuggaaugggauaguuuaagugagguaaaagaaaauaaugcuagaugagacuggaaugcauauguagcagaugaugaaugucucaauuugagguauauaaugauuuuaaauuagguacccacgugcugaacaaaugaaaaauaguguuacuauaugauaccaagaaaagaguuaaaggggaauugagucucgugaggagagaaugcaaauuuauuuguguucgagaccaaagaaaguaauguugauacucuaaugcagagcccaaaggaaaaugauugaugaugaugaugaugaugauuuuuuucaaaaaacaaauauuuaguuaugucgacgagaacauuguugcuaucuucacacacacaccaaagauggcauuagauacuauuacagaugguugugagccaccauacgguugcugggaauugaacucaggaccucuggaagagcagccagugcucuuaacugcugcagcccccagugaugaugaucuuacagcacuuacucugccauaaaacauucaagacuguaaggagguacaugggagaugaauacacagugugaacuauaggacaguugggaagaagcgaggagaggaucaugaucugaggauaaugcagucugucucugaauuccuugggugaauguguuguaaaaacauguguuaagaaguugcaaaguaaagugugugauuggagcagcccagaggccggccagccuugagacuuuguggucaguguucuguuccuagaauuguccuucgcagucucucccacguucuccacacuuucauguuucucucccucuuguuaagacgcugucuguuuacucuucuuuucucuucuuucugcuggaguugcagguaugccaacagccacaagugguauugaugaauaagauggggcagcucagccuuacacaguggaaacaccaggagccaggaugaggcagagcugccuccaugcccugugcuggaggguuagaaggaggcuggucuaguugccaguaaacugugcggcuguggcucugagucacugagccaucagacccacacaccuguuccuguauggcagcuuuccuauacccaguacaguuagguuugcagcccugcugggaaggagaugucaguauugaaauauuacuaaauacucuugcuguuauguaucuuucacagaugucugaacacauguauuauacugucuuauucagaaaacuaaaagauuagagacuuuaguaaagauagcuuuuccuaccauugacucagacauguuuacauuucuucuuuagcaaacaugauuaaauauuuuacauauuauauaagccaaucucauccucuuccacuuccucacuguaauucccaccacauuuguguuuguuucugucuacguuuuuugucaccauuccugucugccacuucuaccuguuguuaccugucaccucuuugacacugucacauuuauacucuacugucugucacucgcucuuucaaacaucugcuuaauauguguucagaggcuacucuacucuucugacuuggucccuacagcuccuaaaccugaaguuuuuuuauugucaaauuuugcuacuuaguaaaaauaugaauauguaaguuucuauaaccuuaagggguuuuuaauuucacucuuaaguauucaugacaagacuucuguacauagcagacaguaugcuggcauacauagugcuuaaucauauaacuugagaucauauaaaagguauucagagaaugcaaaaauaguaauaaauagucuuugguauuuuguuucuaaagauauuuuuggaacuugagauuucacagauuaaggcauccuguggauuaaacauagaaauaagauacugauaucacuaguaucccuuugguguaugcacuuaaauaaaaguuguaucauccacagcaacagugacaguauuccuaagugaccuuggaaccuacugggcauguuacaaaguaaacaaaauuccccuugcaaguuccaacaacugcaaggcauuuggauguggugaaucagaccuccuggcagaaaauagugccauguggcuuguuccauguguccuguguuuggcaagguuucagacaaagcacuuuugcugguauaaacccagccccaauacugaacaggauucuuaguucauaaguuucuauucaauacaaaauuuuaugcauagauagacauagcaaaaccgcucccucgccagccacccagcacauaugcacucuuacuuucucaucuuacagugaguaccucauaaucagccagugugcuuugagaaauaggcuuuucagacucugucucaaugagauugggcucaucgcagauaggauaugguucagugucuuugguuuucacaaagcauaucuacuaauuuuagagaagucuuaugcaacuuauagagaaagcauuguauuucuauucuaauuccaagacaaucagugcagcaauaagacguguagaauucuggggauagcaucacagugcauuuucuuuccuucccccucuccucaaguuaucaaaaguuggcguguucguacuuucuaacaugucauuaaauaucuggguagaaaaaaacuaauuauaaaauugugaguuugcuuaaaguaauuguacaauaacuucagaaaucaaaucuauacuuaauuguauuuaaauguguacaucuaaauaucccuauaugagcuaccauauauguuauauaucaguguuaacugauaaauugaaaauaguacugauuuuguuguuuaaaugaguuuauguagauacaauucugauugucagaaaagaaaguuucuauucaucgacacaguuaacaauuauaguucugaaugaugaguguguaguucucuuagucaugcugaaaguuggccaugcuauacaacaaauugaacacacaguugagacugaagauguaaaguguaaauuacuuuuauuuaauuaucuuuuugaaaaacauaguccuacuucugucuuaguuaggguuuuauugcugugaagagacaccaugaccaaagcuacucuuauaaaggacaacauuuaauuggagcuggcgugcauuuucagagguucagucuguuaucuucauggcagaaagcauggcagcaugcaggcagaaguggugcuggagaaggagcugagaguucugcaucuugauaggaaggcagccagcaggagacuuacucuuccuuacugggccaagauuuagcacuaggaucccucgaagcccaccuccacagugacacacuucucccagcaaggccgcaccuccuaauagcaccacuuuucauaggccaagcauauucaaguacgacaguccuuucuggaccacuaacacuaguagacuguaaagagacauuguucuugagauucucuucuggagccuaagcaccuggcgugcgaugggcacuuaguaaaaaagguuaugaaauauguuugauccaaauaugauuuuuagauuuuuuacagauaauaacuuauuucugaaauaauucugcaaauuguuuuaaaagcuggauaauaauuuugaggccuaauuauauaaauaagauugugcacagccuggagaggguuucuauugugcuuuguaagguaacgcauacgugggugaaaaaggcagccauuguuccugggugcuugagaagcaccccugcugugugagggcugucagaccacuucaaaccuccacuaugcugugguguuugaagcagcaugggcuuuaccuuggugaaugggugugaacggaaaagacaugacaacuuggcucuggaaagagcuagccuuauucuaaauggggaaguacaggaugaaagucagaaaauaccaaaauaggaacggacuuuguccugaacaaucacaggagcuuuugcacauccugugcaaguuacaaacuucugaggaaagcuauagaaaaaucuauuacuaucgcaguuguucaaauuacugacuaaagaacauccuuuuccuuauuggaaaguagaggaacuaagcugugugaauaugucaucauugaaauuauauuucucagaggaaauuuucaaaaccaguagcgucgggccuuaauucuaguaguaugcauuauguauguauguacguaaguuuucaacaguuacucuuaguaagcacuacacgaguaaaacgugagugccccacaucuggucacggcaaccuucucuucugugcuagguacugacugggcguccaugggcgguauaaaguacuguacgcacaguagccuauggggagacaguguguugguucugaggcagcucacucugguaaaugggcaccugauuuuaucacugaguaaugcauuaaaaguccuagaauuacacaccucccacuuccuccccuaaaaacccaauuuauaguugauaaaaaauacaggaaaaugguucuuaaauguuuaguagaaauaauuaauaaaauaauggaaaaauaaguaucuugaaaaugucauaaaguaaaaaacugaucuuuaccuccauucuuauuuugcucuauuacugugaacaguuuuugauuuuaguuccagggagagccuguaugaccuucaauacauacauuuuuuuuuuucuugauuacuagcaguggucagaaucuacuggcuuuucuuuuuaaaauaugaagaaauuaguauaaauauucuucucccucauuccucuuuaauaugcuuaauuuuuaaauauauauguacauauauauuuuuuuuaaaagauuuauuuauuuuauuuauguaaguacacuguagcugucuucagacacaacagaaaagagcaucagagcccauuacagaugguugugagccaccaugugguuucuggaaauugaacucaggaucucuggaagaacagucagugcucuucauauagcaugcaugagagccauguuuuauuauauaauuguagauauaucuauauccagaaaaaggaacaguaguaugugcaguacuauaauguaaauuuuucaucauagaaucaaguagaaagauugaaguuacacaucaaagaauaucucccuagucuucuaccacugagcuuugccuucaaauagguuuccaguauauuaaguguguagugagauucuucuaacauuuuuauaggaguguauaauauauuugauuauauucaaccccaauucucucuuguccuccucccauuccuacucauccccuucacagaauuuucuaagcacccaaaucuaauuuucuuucuaauuaucuugcuguuuucuaaggcaacuuuacucaguauuuauuuauccaugaaaucaucauuaacauucuucauucucuauuagauggcuucaagaaauuugccaggaaauaugaaugauuaguuuuagaauucucagcuuuuuaucaugaauucauuuugccuuuaaagugauauuuccucuacaauagaacuugacuagauguguuuaugacacacugcacuguacauuuauuuuacaugcauaaaauaucuauuaauauauaguagguauaaaaucucuaaaaauauggcuuccuuauuuauguaagaagucuaaacacaaaugucauuuguucuguuugugaauagaucauguuggcuuucuguggaguuagcagagacauuggaauccccaggggaggaaaugaauagaccaugaacuuacacacauucucauauucauucauuuucucuuucucuuucucccccccccccccuuccgcccugguguuguaaacagaaaggcuggauacgauaggcuaugcugcucaaugagcuaacuguuuagcaucaugaacuggcaugcccuacuuccaacugugugucccccacauuauuuacuuuuauuagaaguuauuaaaauacaaagcaauaauauuuuucuauuugaguaauuuuauuuauucaaaucaaguagacaaaucaaguaguauugauacugcaguaaggaguucuugaauaucuucuacuuccuugccucucuuuuaauaagggacuuuagcagccaggagcagauauaaagggaccagaguuaagucaacuaugaugugucuuuccauuucaugcauguaguguuuaaauauguuugguccagggaguggcacuauuuggagguguagcccuguuggaguaggugugucacuguggguguggucuuuaagacccucuuccuagcugccugucccuguuugccuuuggaugaagauguagaacucccagcuccugcugcaacaugccucccuggaugcugccauguucccaccuugaugaaacuggacugaaccucugaacauauaagccagccccaauuaaauguuguuuuuauaagaguugccuuggucaugguaucuguucacagcaguaaagacagcccuaagaaaagcccuaagacagaaguugguaucagagacuggauuauugcugugauaggccugaccaugcuuuuguuugaaagaauguggauuuggggacuuuuugauuuggaaagccauggaauguuuuaggagagacuuaaugagccauccuaguaggaauauggaagacuuuguugcugugagugauuugacugugcagaccuggccugagaaguuucaguggagaagaauuuaugugaccuagaagcuguuuuuguggaugaagaauguggcugccuuuugcccuugucugaagagucugcuugaggcuaaggugaagaaacucagauuaauugcauugacaaaggaagucucagaaacaccaucauagacuguauucucugcuuaaaucucaugaagagcauuuugcauaagcauagcaaacgugggaaggaaaaauauaaaauguauuguuugaguauuaaaaggacaccaggaagugaacauagcugaauccuguguucaaggauauuaaauugaauuaagaaaguggugacccuggggcaagaucucaccuaccuaaguuuaagucaaggccuggugcuauacaccuuuaaucccaggagacagagccuugcagaucucugaguucaaggucaaucuacagagcaaguuccaggauagccaagcuuuggcagugaggagcugggaaacagaaagcuaguaauagaauaauggaggccauguuccagccccagcagguaacagacuuggacuuuagugcugauauauuuuuguuaauuuuuuuauauguuuacuuucuauccaaaacucuagcuuauucucuauuauacuuaauagaaagguuugaggucauuucuuuauuauuaacuauuuuacuauuuugccugcugauaucaucuuuugaguggaaaaacaaaagguguacuguuacaggguauaugagugguucuaucugaaggucugaauuaucacuuguauucuuccuguuuucucuuuauuauuauuuuaaaucaguaguaugagauaguaugguccccuuuacauuuuuuuaaaccuuguauauauaauugagaggcuguaugucuaaagaaauaaauguaagauccuuauuuuagcaugcagauuuuuagccuuuuuuuuaaaucuuguccucccauuaaauuagaauaauuuucuuccuuguuuagauguuuuggugguuuucguuuguuuuuguuuuuuguuuuuauuuuuguuucacuuuguuuugguuuuuugagacaggguuucucuguauagcccuggcugucuuguauuuuuuccuguaauaaguguauugaaagcuuugaggaaagggcaagugcugcugugggaacccauuuacauuugguugguauccuccccacaccuccauuuaggucauggcaguguucauguuuaaggucugaaagcuguuacuugauuauuuacuacagguugggucaaacacacugaugguugguucaucauuuguuuauuccucacauuuucuguuuccugugauggaaccguuuugaaagaugaaaaaaaaaaaaaaaaaagaaaagaauucuuguaaagugacucuaugccuguguguuaguccacaucuuguauaucugucguuguccaugaucaugccaccgcaaaagaaauuuuauuuauuguuaaauccuucaguuuucaaggugccuugagcuuuuauucuuuguauccuuacacuucuaauauuaaaauaucuuaaaugaauggaguagugaggaauguuuuuaaauauacauucugcuuccuuauuauaauagaauuuaguagauauaaaacaaaguguuugguaucaauacugugugacuuucuagagugcauuuauguccaauuaacuggauguaaauucuuuuaggaaauccuuauucuuagauuugggggacaggggagaaagugcgugacauggcacgugugcagagucaggggacaccauguagauaaugacagccuccaugcuguaggcuuggaaaugaaauucagggucaucagacucauccaaggaugcugcuuacccauugagcugucuauuaaauaccuuggugauaaacucauucauuucugcaauuagacacuaaagaaaauucccaguaaacacaaaauaaaaagacuaauuaagcacauguauauuugcuuaguuauguauauauguauguauguauguuuguauguuuguaugcucugacauauauagcuugaaugaaguguuuuauaccaaauuucuuuccuuccuuaacuagguuuuguuugguucuaauguauuuuccucuuuguguucaaaggguagccauucuacaaaaguggaagcuguggucagaacucugaugaaaauacaacuuagagauccaggggccaaagcgcucguuuucucaacgguauaaucaagacuuucugcuucagucuagcugguuuuccaccucuacuuagugucuaagaacuacuuagaaauacugaaguagagcuaagacucggaauuacugucauaguuuuucuguguccuuauguuuauauagagagaaaugugauaauacuuuauaaaggcaguuccuaucauguauuauacuuuauguuaauaucauuuagagauauuuuugagauuugaacaaauagaaucuauaaccuucaaagauucguucauaaaugaaauggccuauuuaagaaaaaguaguuaauguacuauaaaaaguauuauuuauaaauauaguaaaauacuaguuuuacauuuagaaaguugaacuauaacuauuaaauacaccauuguuuuuuauuuauauuuuaauuauuuucagugaugcuugugguuuuuuauauuaucauucaacuaguauuugaugagaaaagaaaaugucguuucccaacugucuuaguuaggguuuuacugcuguaaacagacaccauggccaaggcaagucuuauaaaaacaacauuuaauuggggcuggcuuacagguucagagguuaaguccauuaucaucaaggugggagcauggcaguauccauucaggaauggcgcaggcagaggugagaguucuacaucuucauccaaaggcugcuaguggaagacugacuuccaggcaacuagggugaggaucuuaugcccacacccacagugacacgccuacuccaaccaggucacaccuauuccaacaaggccacaccuccacauggugccacucccugguccaagaauaaacaaaccaucacaccaacagagcuaguguuguugauucuccaucugaggguuuuguuugguuuugcucauuuaacugaaguacaaaaguuacugugguuuaguuaugauuuauucucuucucaaaucucuuuggcuaaaugcuguguguaaacacuuuuuucucacuuuuauauucuaguggcaagauguauuagauauuauuucaaaagcucucacggacaacaacauggaauuuacacaaaucagucgcauuaagacauuccaggugugucaaaauuuugcucauguuuuuaacagaucaguugcaaacugaaacugcuguuuucuggcugacuuuguuuaucuucuguccugaacccuauaagaagguuuuaaguucuugauuaucuaggaaauuaacaucuuaaaacaaaauaaaaaaaaaaacuguagauauuuuugauauagacaaacuaaagauugucuaaaagacagucuuuuauaaaacauuuuugucuuuagaucuuuuucuuuaauguaggaagaaauggccuuguaguauuucuuuugaagggguccuuguacccuggaauuguuuucuguguacacccccacacacacucauaaaaaaaguauaugugguuaaaauuuugcuuauaucaaauucaguacagucugaccuauaaucugagaugcacugccugcaagaauaagugaaaaugcaguagcuuacuaucuuaccucacaugagcuuugcauaguuuuccuuucccucaucuuucucuacucucauacaguucaguugucauguaucacauauaucuaugauguaguuuccacuacaugcuauaaaagcaaaaguguucguaugauucucuucaaaaucaggaaaaacaacaacauuccaguuccuaaaauugguggauuagcauuuaaucuucacuaccauguucaucuugagcuguaacguaagugcucugauucuaauccauccagcuaaaguucaaauguaccuuucuucuuucaggagaaccucucagcguuuaaauacgauccccacaucaauauucugcugcugccccugcacacaggcucuaauggauuaacuaucauugaagccacccauguccuccugguggagcccauacugaacccugcccaugagcugcaggccauugggagagugcaccgaauuggacagaccaaguaaggauggaaauuggcauuugucaccuuccuucagguuaugagaaacuaauucaacauuuaaauucuuuauuuauguuuaccauacccugucugauuuuuaaguacacauucugucucccucaccuaaaauguuuggaaccagaaauuguuuaggguuuuuugguuuugcuuuuuguucuuugggggauuuguuuguuugguuggcugguguuuuuacauccuggacuguuugaggaaagggucuauauuuaaauauaagauugauuuaugauucuuuuaccucauacauagucugaaaauaauuuuauauauuauauuuaguauguauuuuaacuauagcccaucacauuuccacguuguuacaugucugcauguucuguggcacgugcacccacacagugaaugacccaagaagucuguguaguuaaaaauaguuugauuuagugcaguaucugaaccaauagucauuuuuaugugauagguacuuucuuuauucaaauaccagauuguaucuguaacucaguuucuuacuuauuuuuuuaggaguauuagaggccuugaauguuugaagacauacagauacacaagcacacaugaccacacacuaaguacuuacuuagucuuacugagcaucuaaacugugucagacauuaugcuacguacuggagauuccaaucauacgacaaucccaucuagaagcauacauaaaaggccauuguguaguacaaguacaagauaauuuaaaguuuuaugaacaaacacaauaugcuaauguguguccugaagaaacacauuaggcugaaggauugauuauuuuaaaguuaggcuagaaaacaaguguggaagaguugcauauguagaauuaaagggcagauaagcugacauuuccuaggguugugaacaguuuggaacugcugagguaaaacaugagaagcaguaaaugaagucuuacaugccagagucggaaauauggauuauugauaaacuucagugauuaacuggccucugauacacugcaucugacuuugguuuuuuaaaugugugugauaggcuagagacugagcuuagugguuaagagcacuugguugcucuuccagaguuccuccugaguucaauucccagugccacauggugguuuacagcaaucuauaaagggaucugaugcccucuucuggcauacaggugugcaugcagcagagcacucauacacaacuuaaguaaacaaacaaguaaacaugugagugcuaaggaucaaacucagguuguugguugacguuuacuuuuacuaguugagccaucuugcccacccccaacacugaccucuuguuauaccagcuuuuucuuaaaacauagguggacuugucuuagacuuagaaggcuaaggccauuaaggcuguugcuucccaguauauagccuuucuuuucuucuucaagagacuaucuuaguguuuguauuguucuccagugacagucuagccuccuccuucagagugccuuaucauuccauuaucacuuacguaguugguguuuaucagucuccacaugcuuccuucaguggucuuuugcuggguacuuucugugugccauguguaguuuuaagcauuugagauaaccuuaugcaacuucuaaucuaguuguaugcaggauaauguaucaaaaguuaguaugcaauagauugaggaaguaaagaguauauuguguuaggaccaaaccucaagcuggugggauaguaaagaacacagaugacuuggaagccagccacacugagaagguaacaucuaagcaaagcaugaaagagacuggaacuauaaucauacuaauaucuuaagaaagaaugacuaagcacacaauaacaaucagugugacaucuguaagucaagaguguuccuggguuuuuguuuuauuauguuuuuuuaaaaaggauccuuuaggacaguuugguaaucuuuaugcuguuauaucguauuuagacucauccuuaaauccuaacaugguggaugucucagcaaaaucacaucaucuaguaagugcagauacuucaggugugagugaaaguaaaaacaaacaaacaaacaaucaaagaaacaacaccagagacuucuuuugauguguauguagaguagauuuggagaucugauuuauagacuaagcauacuucuuuggaauuuuuguauuuaagaaacaaaacuguguauaauauacuggaauucauguaaaaacaaauuuccaucaacuuaaaucacucuuuaccauuaaaauuauuuuuaaaauuguauacccauguaaaucuuaauuacacgauuuaauaauaaagagcuauacuuguuaacaugcuaaaaagaaagaaaaagaggauccacagaugcuacacugaaaucgguaggaaagaaacucaguggggcuugggaaucauacugggccuuaauugggaagcugugagcagaggaaggacacaucucacuucagccuugaaacaaucauucugaguacugugugcaggcuagggaguaaggggagcagggaggccauguaguccugaugacaguaggaggcagcuuguaugguaauggcagugcacccagugagaaguuuugaggcucucgguuuauucuggaguagaacugacaguguuuguaggcauagugguuagugggugagcaacacugugggcuuuggccuagacagcugagaggauagaaagccuuuggcugaguggaggaagacuaugagauagaacagguucaguggcaagaacaaaggucugcuuuagauauguuugagauuuuauuagcuauccaagauauguauguucagagacagggagagaagccagggcuagaggcacacacuuagacaucaggagcaugugaugguauuuuugaguuaugagcaugaauggaauuauaaaggagagaaaaaauagugaugggccaugaacuaaauaaauucuggcacaaguaagcuacaaagcccugggaaaagaaaagacaccuacaugcuuagcuguuaccugcugcuaaauaugucaaaauauguuaaaaugucaaaauagaaaucuuccuauuagaguuuugaccauuaauuuuauuuuaucaaaagcaguuuaaauggagcaguauaggcaacuacuuauaaggauuuuuuguucaacucuaguucaacaaacacaaauaggauuacauagcuuguguagugacacggcuagguaaacaguggcaggugcaccccugcuaccugccugucccugcuuuaaccauggcucccuacucuuacugugcagcccauaggaauaggauuuugagagauuuuuauugcagaguaaaagaagaagagaauaaauuuaagaauuauuuucuuuuuuaaauuaaaauauuaauuagagaaugauucuuuuagaaauagaaaaacuaggaaaauauggaagaagugugcugaacauuuuccaugccugggcaagaggauacgggaccuaacacugauuguuuucaagcgagaagaguguggcucugguaaugguuaagagagcauagcauaggggcuggugagauggcucaguggguaagagcacccgacugcucuuccgaaggucaggaguucaaaucccagcaaccacaugguggcucacaaccauccguaacgagaucugauucucucuucuggagugucugaagacagcuacaguguacuuacauauaauaaauaaauaaaucuuuaaaaaaaaaaagagagcauagcauaguguuugucccuuuauuacaguggaagagugucuuuuuuuaaucccacuuguccuaaaucccaccucuuuucauauucucaagaggcuucaucuugaaaaauaucacauaaauaugucugaguguuaaucauuuuuaaagugacacuccuuuauagucuaccuccacccgcuugauguccucuucugucagccuuucuauuuugguggcugccccugaguguaccacugaaaugaggcuuagaguuuaacuggugccuacuucuugcuguggucuagugguuccuuuuaucuacucucccuaguugcuaguuuacccagugccaugacauuaaguaguaugaguggguggacgaccuucaugggaguauccuugcgccucgauaauaccagcuuuauauaucuagcuauuaucuguacauguaucuaggaacuuuauauuuccccuauuuccccuaggauaucgacuagauagcuuaaguuugacacagguagagcaaaacuacaucugugcuacucuaagccagcccaagcuuuccucauauuuuaaugugucuuuugucaucuauacuugcucagacaggaaucuaggacuuuucuguaucuuauauucaaauuauuuuagucuugauucuuguauuucaaagauauuccucauuuuuugacuaauucuuaucccgcugacacaaaagcacaauccaucuccucuugccaggaugaccucaaauuauaucucuucucuuccuccauagcagccaaagcauuuccaaaguacagucuaguguaaaucaaaauauguauaacuacuagagcacauuucuuuauaacuacaaaauccaguuccugguuagauccugcaggacuaccguuuaugaucugaacccugcccgcccguaaccucauguugaccuguugcguuuauaacacacuugugccaugcucgucugcuguuggccccggaaguauuuuuagcuuuucccaagcauguacucauccaguaauauauaugaacauugguuucugucugcaugcauuccugucccuccugugcuuagugccuaaugcccuucucuaacugaacuugccauacguagucugugcaugcaacugucucccucgugagaggguuaguucaugaagaucacauuggcgguaugugcuguugacuugucccugagcucacucauaaagaccugccacaagugggcaccaguggacuaauggauguagcauguguauauaaggucauuuucuacucauuugucuuaagauggucuuuaaacuuaaaauuauuauuugccuucuagaccuacuauuguacauagauucuuaauuaaagcaacaauagaagaacggaugcaggcaaugcuaaaaacugcugagaggagguagguaacaacuuacaagugggauuucccaucacuugagaguuugagaucuucuggaugacaacaaaugauguaaacacuaaauacuuuuucuaaaaaccaaagaaaagcauguuauccaaagcaugucccaauuaauguuuuggacagucuauauuuggcuuaagauaauuuaauagauuacaauaugcacaauuagcuggcuuaucuuugauauauuugauuacuuuuuaaaugaaauguauuguucucucuuagcuaaacuuuuaucugauaugugucaaacuaaacaugcauuaauguuuuauaguuuaugcuuaccagucacgcaauaggcaugucugaauuuaaagucuuggcuguugauuugugucaaauccauagacaucagaguaguagaaugaucagagcagucugaauuaggacuuggucuugcagucauuacucuucuaacauuugcacgguaauuuuccuucaaagucauauugaaauaaaccaguaccuuccuccuccccgugaaaugggcggauuggaagucacccaaagagagaugauaugauagcucuuucaaagggagggcaucuccaggguauuuuguaacagaaaccuucucaaaccagaaauuccauacucugauguaacaagaaagaugccgccauccgaagggcuuuucaucuaaacaugaaagauguuuguucuuguugucacaugcugcagacauagugauuuucguuucaguuacaauaauacugaacuucuuuguaaauggcgaguuuagaaccugcuugacaacaguugucagauguuuuaucuucuguuuuuuauuuguuuugauuucuuauuaauuguucauagaaagcauuuucugacaaagcuucagaauuauuuagacauuuucacugauuuugacaagauguaacaauuacugucuacuuguggcucagugaugaccacguauggcagaucugugccucacuuuauugucaugcauauagucucuaacuccuggccaugccuucucucugugccucugaaacucuugcagccacacaagcucauccggaaagcauucugaagccucuguguugacuguggcuggccuggcugaccuguuuaccaaggagaacgaggagcuugaaugaagccgucacaucauuccacacaauguuaagauagaacuucacuuccagagaugucaagagaguuacaaauuaaaaacaaaaaaucaguaaauauuaguaaauacuauuuuaaguugaaugaauuuauuuuguuauacucuagccuaguaauaauuggcaauugguuccuuuucacuauaccgauuucacaccauuuacaaugaauuuuaacuuuacacuccuaauagaacauuaauuuuuuuguuccacuuguauaucuauuacuaauaaggcaggggaauuaagaaaagggguauuaaauaauuuuuccauuaguagauagauguuuguuauaacaggagagaauauauaagaagguuacuuagucuaguuuuguaugaccugauguguacagccaguguaaauaacauuuuugaaagggccuucagcaucuuuagcauaggauucaccauuauauucucaguaauguuuuaagaaaaugcuaaacuauauaauaaguaguuauuugcaugaguuuaaacuguaacacugucauuagcuccuaauaauaaaucacuaggugguuauauuguguuuuguuacuaaauguuaaaauacugaaaaauucauuuuucuauuauguuuaagugguaucauuguuaauauuuuuaaguggauuaacauuuaccuacaaugaucucuuuaaccuuuuuaguaaguuuuuuuuguguauguguuuuaagaugauguaucuguaaauauggcuuuuuaaaaaucaucauuguacugaauucauuucuuguguuccuguaacuagucauuuuagccacuaguuaucuaaaccuacaauagaguuuauucauuucaguuacucuguucuuagaaacuaacuaguguuugaucuacuacaagagaacgcuguguucacacaugcauaaacuguaagugguuaaacucucucuucugugaagaauucauggaugacuuugaaauuacaaaauaagaaguagcuuguuguauccuagccuuguguuggaauauaaauguucuuguuuccuucccuuuagcuguugaaaucaagggacccucaagguucauuagcuccuaccuaacuguccauaaaacuguacuagaaguaguuccugggucuccuuuaucccgugagcucuggugcuuaagcuaaggugcauuuucuuauccagguuuauaggugacaggucagcugaagaagacacguuuuuugggugcuuauucuuuaguugaagggagauauacauugauucuuuuauaugaaauuaaacauaauauuuuuacagcucuuuuacauucacuaagagcuuuucuguguauucaugugguuaauauucacaacaguccugugaaauggauaugauuaaugauauuccuauuuugaagguaaagaucuaaugcucaggaggaaacucgccuaugauauguagcaaacagacagagcaguccaggcccccuggcuucaugucuacuguucuuccaccgaguugugugccaugcugggguucagaagccuuguggguaugacuuagaaugggauuguguaaguacuuauuuuuguuuccuaauauuucaugugcuauguucuaggaaaaacaauuugauaugcuucaauuagaaaauaacauagauaucuauacugaucaguauuagaggaaaacuauucuuauuuauuucaguaagauaccucaauuaaauaaauauuuuaguggaaaaugaa

SEQ ID NO: 12450 - RNA, 40909 nt, Mus musculus
auugccagaugcuuagcauuuauuauauguagguauauaugccagggaauacagucucaaaaacgaaauacagagucuaaaaaggauaggagauaaauucuggggaauacagucucaaaaacgaaauauggagucuucaaagguuaggagauauaugcuggggaauacagucucaaaaacgaaauacagagucaucaaagguuaggagauauauacugggcaauacagucucaaaaacgaaauauggagucuucaaagguuaggagauauaugcuagggaauacagucucaaaaacaaaauguagugucuucaaagguuagaagauauaugcuggggaauacagucucaaaaaugaaauacagagucgucaaagguuaggagauauaugcugaggaauacagucucaaaaagaaaauggagauucuucaaagguuaggagauaugugcuggggaauacagucucaaaaacgaaauauggagucuucaaagguuaggagauauaugcuggggaauauagucucaaaaaaaugcagugucuucaaaagucgggagauaugugcuggggaauacagucccaaaaacaaaugcagugucuucaaaggucaggagauauaugcuggggaauacagucucaaaaacaaaguacagagucaucaaagguuaggagauauaugcugggaaauacagucucaaaaacaaaauggagauucuucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguacauagucaucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguggagauuauucaaagguuaggagauacacguuggggaauacagucucaaaaaugaaauacagagucuucaaagguuaggagauauaugcuggggaauacaaucucaaaaacaaaauacagagucaucaaagauuaggagauauaugcuguugaauuccaucucaaaaacaaaaugcagggucuucaaaggucaggagauauaugcuggggaauacagucucaaaaacgaaauacagaguugucaaaggucaggagauauaugcugggaaagacagucucaaaaacgaaauacagagucuacaaagguuaggagauaaauccuggggaauacagucucaaaaaugaaauacagagucuucaaagguuaggagauauaugcugggggauacagucucaagaaggaaauacagagucuucaaagguuagguuuuacacuuucaaaaucgauuaacaagguaucaagggagauuacaaguacgguuacauugcaaaacacaauccucuugggauacaaacuaacaaugacuuaaauugaucaucuacagauacacuuuucuauuggugauuacaaacaauacuucagaacuuaagcagcuuaaguaguagguuaagcuaggcaaagaaaauucuuaucuaauauacuuaugcuuuuuuuaaauuccaguacauuuucuuaaauuccuguuaaaaaacauaaugaguaucacaguccacaaaacacuuuugauugauucuucuuucaauuaguuggccacuugacuugguuacacagugauuucuuucuucugucagauaugacugacaaccaguuuugucuuuaagauaaaugaagucguaacucacauuggaacaacaucacaugaaaaauauugaacaguacauuuaaauucacuuuaaaaaauggagacaucaauagcgucacacucuauaaagcuacacaaugggcaacaagaagaagaaacuacagaguaagcuaacaagaagaggaacuaaacuguccauuucuuauagacgagucccugaaaagaaacacacagccuaguuauaaacgccauacaaagauuauccccuucucuuaaaaacaccuuccaaguuggagaauuccaaacuuuaccaucauccccuuccuaggcuacacacaguuacauagcuaacaucacuacaacagcuuacacucaacacgauauuuacaaaauagcagcucauguuuuggaucuuaucacguaaucacgugauuauaagauaaugaggauaauaugaggguaauaauaugaggguaauaauacaaggguaauaauaggauaauaugauaauauuugcaguuugauuacagaaugcacacacgcucacuaaauuugguaggaagcaugaauacuaaggguauauauuggcacaacgcaugcaguuagagaauucuuuuucucaagcuacuuaugacaaauaagcuaaaaccccauuccuguuuuccaaugcuucuccucaaacuguaacugauguuuaaaacaucucccacaagagaagcacccucuuaaaaaccaauuuaucuaaaugcgugauggaaauggggcaggauagcaguguuggagccagcugugaaaauauggggaguuggggguagggggggcuggcccagauucacagcacucacugcuauuugggcuucuucuggcuguggcucuuccgcuuccucuuccucuuccucuucuucugccugugccucugguucugcuccuuccucugcuccuuccucugccucuucuucugccucuuccuguucuuccucuggcucugguucuggcucuggcucuggcuccgguuccgguuccggcucuggcucuggcucuggcucuggcucuggcucuggcucuggcucaggaucaggcugcugcugagguugcaguugcggcagcagcugugguagcugcagcugcaguggcugcagcugcaucuggggcugcaucuggggcuggaucugcaacugaaacuguggcugcaucuguggcugugguaguggcuguggcacuggcaguggcuguggcaguggcagcggugguggcggcggcaguggcgguggcugcugcugcgccagacagguuauccuauggggcaguggcuccccaggccccacagggauggugcuauucacaaagccauucuggggaguaggaggggggagcugccaaaaccccaauagggaggaaaucuccagagaggcaggaauggcuauauucacagcaucuaccagcagcucuuuggacagggugacuuucccaaaccccuccauaggcaucucaaaacauggguugaacuugagaggcgccugaggcucuugcagaggaaauuccucaaagaaacccacguugcaaaaggccuugccaucugcuuugacgggcaugccuacaaauggggcauaugagguaggaacaggauuauacuuaugcuccugaagaauaauugggggaggagaggugggaacuacgccagggugcagagugaaagacggcucuggcauuggcagcauuggcugcauuggcugcauuggcugcauuggcagcauuggcugcauuggcagcauuggcugcauuggcugcauuggcugcauuggcugcauuggcagcauuggcugcauaggcuccaaaggcugcaucggcuccaaaggcugcaucggcuccagaggcuccaaaggcucuaaaggcugcaucggcuccaaaggcugcauuggcuccaaaggcugcaucggcuccaaaggcugcaaaggcuccaaagacugcaucggcuccaaaggcuccaaaggcuccaaaggcuccaaaggcuccaagggcggcauggguuggggagcuucuucuggggcagcaagcacuagaccaugaaccucggguggcaagccaccaucaagcccguucucgggagccgcuccuagcuggaaaggaggcaugggaucaaccuuuaucuggaacgaaguugaaggcgcaaugaguuggaaauugcucugguaaucuccugccugcauauucucuugcaucagcuccugggagugggucuucuuggugugacgagugagguggucuuugcgcccaaaucucugggcacagaacugacacaggaaguccuugcauccuguguggaccaccagguggcgacgcacaucuuuccggguguagaagcaucuaucacaguggucgcacugguauuucuucucccugggugccugguuggccuuuucuuccgcgugagacuugaggugguccagcaggaccucggugcuccccagcuccagggugcacaccccacaggugagaucgccauugcucgccgagugcagggccaggugccucuuguagcccagcauggugugguacuucuugccgcaaucgucacacgcguaggagaucuuguugggaucgugggucuggaggugguucuucaggugguccuuccgguugaaugucuucucacagugaguacacuggugaaucuucuguggcgaguguguggccaugugucuggaaucagaaaggaggaggcacaguuugcaagagaauucuuuuaugaaggaaggaaagacagaggcaacacuaucaagauguuaccuguuacuuucucuaggucuuagugacauuuucacuuauaaacuacuuuuucuguauuuucccuauggacacaacacuuuaccauuuaaaaagcuaagaauuacuaaaaggcagauucaacuuuaugccuauaagaaagacugaauuucccuguuaucaauagauuuauuuaaaaacaugguuaugaaauauauuuuucagaaagggguuaaauagguauaugauacuuuccagaaguuucugaacuacccaguuugaccaaauuugcauaaaacuccucagugccacguuagguuggcgcccaucacagcucuuaggcauucucuacugauugagauuaguuuaguuuuuaagccaguccugccucuauauucaucuguuagguaccauaugggauggcauagccacccaaagccccuuuggaguacauuuuaaacccauucagcagguaguucccaucaugcuucagggugcucauuccgaggaagacauccuuagaauccagucugcucugucaaaucagcuauucuaacccuugguugucucuuccuaguagcuguuuaauguacugggacccacauucccuuucugguuaagcaaggcaccuauuucaugucaaucucugcuuauaaaauggaacucagguggcaaugguugggcacuggaugcuaugcugcccuuuaagaugaacccagccugcccucuuaguuccuugaaaguggauagccucuggccagggaagacagcagggcugggacaaggaacagugggucuuggauaauguccacugcuuccugcuuuuggccuacuuuccaccuugauaaaacaaaucauuucuccccaaccacuaccucuucaacagcgcuuaaagcacccauuugaauucccauugucuuucuaacuaacucuauuuacuacaauaaucuuuugccccucugugcuuucuccccaggccucccauaggacccugagguggccccacugaagccacagcuacccucaguguuuaaaucaggauggccucguguacacaaaaugagucugauacuaaccagggagccccugacacaaucagugcccgugguugggcccuugaugcuguuacuaugacaacuagaaaagggccuacaacugaagacauuugaaauguaaguacagaagcauuuucagucuuauuuuaaacaucaacuuauauuacauuaucagugaugguguuguucuuaaggucaggagcauaauuuauauuuuccuuuuaucucuuuuaaguacuuuccugugaaguaccccgagauggaaugauaauguagggcuucuaccacucagacuggaagcuggguugcugauucucccaccuaugcauuugaaugugagucgucagcaaagugaagcuugugggaucauuuugugacgauuagacacaagcaauuccaagagaaguacacagacagcguucacugucaguuaggcuguagucugaucgugugguuugucaaugcugugguauuaccaaaauccauuguggacagaauguacaucuuaccuaauaguagugaguacauaacacuagagaaauaauucauaucauauaccaacucucuuuuauaggauucaugugaaaaaucacugcuuugguagauuguggagucucugaaagucuaagaaauauacauacacaaagucuaaacacacaagugaauuccaggugccauggucaucaauggcauaccggacacuccagucaucacugacaauagggcuuuaaagagugccuaaaaggcuaaaugcacccacacucugccuucuuuccccuucagcgagagcccugaaggccugaagagacacuuaaaggcccaaguaaaagcgcacccccuucuaaagcaucucaccucaucagcuuauacuuggagacgaaggcuuugccacacucagccuucgagcacuugaaugggcgcucccuggagugggaauaauugugaauggugaacuucuccagggugacgaaggacuugccacauuuuugacagcggaauggagccauggccuuugguucucacacuuucuucuucagaugugcugaggaacugcugugccauuuaagcccagacagaaagaagguggggagucacuacagccugacuccagaaaggcagcgcuacagccuagcagccaggagagauccagagcacaauagcuggguaucugcagagagaagaggaacagauuucucacaucagcuauuggaaaacuguauccccccaccagcaccagcaucagcaccaccguauucaagccugcaaucaguauauucuuuuaagagguucagaugggccuggcaacccauccucccuuucuugcuucccgccccucuggagccucugugcucugguggcucaugaaacacucuccuaacaagaacugcuaccuccauagacucaaaaucaucaacuuuauaguuuucagaucagugugagacucaguugacucaaggggugugggggaggggagggacacaagccucccucuuagugcguuauugguucacaaugaccaccccuuauucaaaccaugagcuuuugcucuucauacacuguaagcauaaaagagguuguuuccaacaccuguuuaaacucuccgaggauggaaagacuucauuuggauacaucucagugaauuuguuuguaagaucacuaugcaugaggcccaauacaaacaagaauauggggacauggagucuaguugcacugauguugugcaccuauaaacccauaaaguacaaaacucuccauuccaccucauagcuaaauuagccaguagggagaauucuguaaucccaucacugauuugccaauucagauauauaggcuguuugcaauuuuuuuaucuaaggaaauuaauucucugcaagucuugcuuuaggagaugaacaguaugcccaacagaacuuucuacaguggagaugugauaugaucaauugcccuccccccaacacacacacacacacacacacacacacacacacacacacacacuacaaguauccugcugggaagccacaauuaucuuaagucagacuucagcagccacaggcagcuaguagcuacuguaggggugacagaggcagacucuuagauuccaugucaagagaugagggaaaggcuagguuucucuugcacgugacuaugcuacugacuaaaccucggguguucugcugaaacacagggcuuucguucagcuguuuuauuagcacagggggaggggagcaagguuccccaguucauauuccaguucuacugcaaaucccagcaucuugauuuauauaaucacauaguauacaugaaugggcugcggggaacaaucaacugaaacaacaauaacauaaucuucccauuugugauuauaaucugaaggaagaaaaucacaaaauauauaguauuuauggaauaaaggccaagugccaugguguagcuaaugguuccuagauauugagcuauguacacaucugagcaguaacaugcugucuaccucuguauaugccuccaauaacucaaaguagaaggagccagcauggaccagagacgugcagaaagaagauaagaagcgacaaaaagaacaauugucauuucucugcagaugcaacccuugacugagucacugcuuaucaauacaccauggauaaaacagaaaaacaguauuuucuccauucuuacagcugucccuugacacuacagcuugccagccccauucucuugucacuucuucccuugauugcaaauauccaacaauugugacuucauccccaccauuuccccugggccuuccaggacugggugcaaucagagacagaugaagcuaggauuuacucaagacugaggcagauuuccuccaacuucaaguucuuuagacagaaaaagcuccacauaaaacaaaaucucucaaaugccuuauacuuagcuuauguccuucaagagcagccuuuccuagaacuuugucauugcuuuuucuauguuguguuaaauauacccagcguaacacaaaaggcaagacucacccucaaacauggagcuaauaaaccauaccaaugagaacauucuuaaucucuuuggguagucuuuuagcgauucucaguuucuaguauugauauucuacucaacauccuugcauauagauauacaugggaauguagaauacccaaauuagcacuguuuuccugacauagucaaaacguccacuaagaaaaggcuagucauguaaauauauaugcuaccucucaaccaacccuuaccuaauucauacuagcuguauacugcuaauucuauucccccauuaaaguuugaugugcuuaaaauagacugucuacuaucuagaaaaccaucaacaauugcaacagagucgaaggacaaugguccugaagagagucaaucuguccugucucuggacauacaaacugcauuagaaucucacacacacauaguacuacuauuucaacaccuguugcccuggaaagauaguaagucuuccuccccagccccggcccaaagucucaggauuucauuuucaguguccccccauucuaaaaauacugagugagugauagagaucugccaaagaccuugagccaucugcuucauucugcucauggugauuauuuuagggaugggaggagaucaggcuagaauaagaaacauauauauauauauauauauauauauauauauauauauauauauauauauauauauauauauauuuuacacacacaggguaacagccaggaagacuguccucccugggggguagagguaugcaacuguaaagcaagaggucagagcacagauggagacccaggacuuccccagugcuacaaaacacaaucaucuaauggggaacaacuguuuuacagcauucucaaaauaaaccaggacuucugccuccuguuuccauuguccccaguaacacaaagugaggcccacaagugaggaaaugggauuuccauuuuggucuuccaagauggauauucuaaguggcuugggucuuuggggguggggguaggguugcuuuugagcacuacuaugcuacggcuuagaggauaaaagguucugagccaugauuucucucucacauuuuuaagggguucuaaauucaaaaagaguuuaaagggcaucccgagguaagaaacaagagagaaccccuucugggagcggucaucccacuuaaaugcuuacaaugaacuaucuccuaauccgugugcuacguaucauuugccuaugcuucaucagaugaaaacggaagguucuaugacaauguuucuuggacaauuuaagcagcaaacaaucuauacaaguugaucucaaguguguguacaggugauaauuuaauagguccugucccagaauucaggcugcucaccaguggcaaggguucauuuguaagccuauuuuagucuucuguuaaguauauaacgcuuacuacuaagauguuagugcuaaaauccccugacauuugagcugacacaucacuuaaaagacacuugccugcgaugaacucguaaauuggcucuacaaggccugucacucugccaugucuacagaccucucucccauggccacccaaaggcaaccaaggccaaagaucaguccacuggguuauuuccuuaaugugcaacauucucuuguagcaaauguguuuccaguccuggaacguggacaauccucuaucugcccugcagacuccuguuuccuucucucccccagauggagucauaaagauggagucccacacugugggguuuacucagcagguuggcagacacuccccaccuacaucugucuggaaaucuuucacuuaaauucacauacauuggugggaacagcuccacuaucaccccugggacagucuccccacagccagcugaauaaucagguuugcugccuguggacucuuuucaacugucauuaauuguuaagccagugacuagaguucuuacucucuuagaaagggggcccauacuaagaaagccaaagggaaguuuuucaaucuaauauucaagguuaaaaugcagggauuaauagaacugauugaaccaagcuucaggacaccaaguacagaccagaccuauacauuuucaaaggaacaacuguuuucaguucacaaacacggugacuaugaucaauucaagauggggacugacuucacgaaaguuacucugccuacucuugaaacucuacuaaggacaaagucacaaggguccaaauguguuacuggaggcccauguugaugucccuucccuaaacaacaaggcuuccaauugguuuucuuuugcuuuugguuuuuaugaaccaccacucacuguaaaggucuaagagagagugauggguagggccagaaauauauagaccaguuagguuucugcccugccucuaaagacagaauuggcuccaauaccacugggcgagcaggcuacuuagauuaguaacugggccagugcaaagagcacaugguguuaguaaggaaaggguccagagaaaaacccugcaaagaacaggaguuaaucuuucugguuuaggucucagauucuuuuuucuuaauggggcucgggacaccaaggagacugaaguacuaaguugcuggugucgucugccucacuauggaagagaugggacacaucucaacucuccuuggguggucugggauucugucucaaagcucaucacaugagcacacuaacucaucaauguuucucuucccugggguaaacugaugaaguucaccagcccugggguccacacaaguuuguuuucuuugaggcaggcagaagccagacuaugccuuccccuuagcuaucuauuuagggcuguagagaaggaagcaggccuaugggaagaugaagaucccagagccccaaagacagaagucucuucccauaaauuccccagcccugacauugcaggauuaggcuauaguaagaaaaaucagcaaaugagaauuaagucucaauuuacaaaaacuuauuaaaaugcaucuaaguaacuugugcacaguggaaguauaaaggagacccaaacagcuuaaaaaugaccaucuuugguugucccauccacuggcaaaguauaaacuuuuuacagaagggauuuuucuuuguuaugguuuguuuaacccucgugugcuaauccuggauuugaauuuguacaaauggguaccuggguguaugugcacacagguuaagaaaccagaaagcagagcaugagaagaaaacaggagaugggggugggcagaaagaagagaauauaauggaauugcauggcaggagaugcaggaggggcugccggaugcaugggguggggggcaggaggaaggagaagggaggggggagaggggaggaagacacacuaacuaguaagaacaaaaguacacauaaaaaugucacagugacuacuuuauaugcugccuuuacaaacuaauaaaaguuuuuaucuagagggcugaagauaccaucaacccacuaaucacggaguuuauacccaggaagagagaaaggaggaagagggaacaauagcuggagaaggcuggcaaaaccaccucagcuggaaugggaaguauaggaaccucaaagugccacagaggaaggagcugugcaggcacagcugggguggggugggggggggggugucagggggcagagcguagggccuaucaccacacaaguguccucugucacagguuuguacucccucccccaacaccaucaccaacccccuucuccuccuacagaguggacuugggagguggguaggggaaagaagggucuggagugacuccauucugacagucucacaggcuucugagggaugagagggagaugggagaagagaacccaugaaaggcuaguuaucuuugcagacccuuguucugccacucggcauccaucacacguggaagaaaaggacaacugucaucucaaggggagcccaacggauaggcccacccagaaacuacaaauguugagucccagacuggcucggaagcugggaugguucaucuuuguuuuaagaugacuauuucuugguggacacuggguagcccugugugagaugaguggcggagaggcagccugacaagccagacaaaagccuuugcaauuaggagcacauauucuaacgucaaagucagggguggagacugcuccuuugugacagaugagaacauauuccccacuccacccucccuguaaaucccugcuggcuggccuuuagaccucuguagggccaccauucuauagcugauaggcgaucgcuucccuugcgauucucagaauagggcaugggcaaccagaacucuaauuagcagcauguccuuuugucccaauaaaaccaucguucggggacagaaaagaaagccuggguccuuucuaggaagugaggggguacagguuaauacugagaaaaacaaaagccaucuggguuacaaugaggagaggaagcuagaucuaugaguuaagacuugcaggaagagacuuauaaucuauacuguccagaggggauucucaaggcuuggguggguuggguagccucacacagugauuucacaagauaaacaggaaagggccaagaauguggacaccuacacgucugucagauggccuggaugaucugagggucuaauuuuugaugcugagaaucuauagagccugaguucugcuagcuucugaguagaccguuuauacacaagguagacaaaaggcaggggcuaugugcugucagcagagagagggacagagaauggugacauggaacccagguuuuagccuaucuggaggcaugaggugagagaaugaggggagagagagagaagguacagauuaaacuggaggcccuucaggcauaucagagcagacucagggagcaguaaguggucuuuggaggucagggccuggcagcagcagacugccuaacagagaggccaucagucaccgcucccuccuauagggaagcucccagugacucuuuccacagugaguccaggacuaaaaucaccacagcacacauuugacaggcacuuaaaaaaugacaaccugugugcuauuauuauuuuuuuuuaaagcucaaucaauggauggcuauccagaaccuagacucugugauuugaaaaagugaacuuucuguaucugcaaagcaaacuguucguguagaaaaaugaaugugaaaugcaauaguauuucauuaucgcgccuuuacaguucuugucugauucguuuguuguuguuguuuuuuuuuuaacgcuaguaaacauguuauuggguuucugcuugucuuuuuuaacuguuauguaaagaaaggaggggacauuucuaagcuuccacaugaggggaggaauauaagggaaugagggagaaugcuuaaaaggaaagaaacacuaauuaggcagcucucucucucucucucucucucucucucucucugccuuaaaucgccccaccccaucccccauucauagcuuuagguccuuuguguaacagaccauuacaaucauacgcacagcacuguucaaugggagaggaaugugaacucucuaaguagacguccuggcaauccacauguguggucccucccccaacacaguggggccccaucugcccuucugagcuccaagccuccuacagggcaggcagccagcuuacaauaaccccaacuucccauugaggcauacaggcagccccuuccggggaccuauagccgccuccaagccucucugcccuuccccagguuggugcccauccuggaugggccuguccccuuugacccccuuaagacaggugucuccuaagcccuuuucuuucuuuagccugugagcucucgccugaaugcuaggcagacacauuccagaucccccuguuaucuguccucugaagucacauguacucuaaacagaagacacaagucaaagauuccucuucucuagccuccucaaacaaguucuccgggccuuuguccauucuugacagauaauggcugacccuuuugguaugaacuuucuugaaguaccuuggaccuccaucacaucccugcauuccugaguuugccaugugcuuccaagcaacuuuguuuuuugaggcuguguaucccuggcuggcuuggaacucuguaggcuuuguacucauggauuccaauugcucucugccugccaagggcugggauuaaacacaugugcaccaccacgccugacccaagcacuucuuaugaagcauguacagagaagaauaauucuuaaacuuccguaccuucugugagagcaggaaagccagcugugaggcagauauuauggaguucuguagaagucugaagacucaaaccugugagaagagaccuuggacaucgucagagaaugaagcuagaauauucucccaugauucuaccucccagaccuucuuucgugagcauaugcccccuuucugcccaggugugguauaaaagagguucccuacugcaccucaauagauggucuuuauuuaaaguauauccuuuguccuacaugcaacuggauuagaacucugaagcuucccuuagcuuucugacagugggggaaaaaaaugaaauugcuuacacaagauauucaaaacagcacucggaggaaaugguguuucuuuuaaaacaacaauauuaaaaugccauaaagcagguaugcaaaucuaggcaguaacagcacuugaaacaaaauuaugaauggaaagaaagcagcaacugggugacaugcauuugacaguuuugugcaagcauauagauuuagcaaauuugcagugcagaaaaggcagacaucucuaaguugaauauguagauaaguggguacuaaaaugacugcauuagaauuagcaggaaaggucuuuuguuuguuuuuuguuuguuuuguuuuguuuuguuaauagcagauuccaaggccacuucacaaaucagcacagacugaaacaacgugaugggagcauggaaaaauguuuuccccuaguguucaagugccuggauuucauaccaaccauggaccacugaacgcugacacauacuuagaaaccuacacuaucccuguucaucaaugcaucugaccacuuggccucuuucaacugaacacuauucugccaaacugauuuucuugcagguagagaggaugccucaggguuuuuuuaaccacuaugaagacaacugauuuugagagccaguucuaucucaucuaaugguuuagucacaggaccaccuguucacuuaaucugaucaaagaggcugugucuguuuguuuaguauagaaacauccuuuuaaaugcagcuuucuuuagacaaguuuaaacaaacaaacaaacaaacaaaacaauuaaauacaguccagaaaaaaacuggaggugaccauguacuugucugaaccuguuuguuuucugucugguccucguucugcguguguaaacagaccgugugcauggguucaucuaauuucaaaauucucuacaacaacuaugaucauuuaauugggugguccccagaagccuggguuaacucuuauuuuuuucaagagauuucaaacacaugaaagcgaaagaauaaaauuagucugaaugacucuucauugagucugcccaacuccccaguagacaauaccaauuuauggauucagagaggaggggcucacuucuccugcccaggaaggggcuuaagggacaugagguucgcaagccaggcaguagaguagcuuggcuccauugucaaaauauucaaaucaucccaaagagaaagccauucuuuucugccuccaacaaugccuggcagcagcggacacacaagagcuuacucuugugguacacagugugaacggcccugaaagagggcugccuagcagggaagagucaagcuacucagccuuucccaccugcccacccagcacugccucacauacacaagcuucaacagugcuggggcgagggggugggugggggcaccuagagcaggccagacagggcccccuuggaggacagucccaugcuucaugcaacagugugauauagcagcaaugagaccaacaagaaaaagaaaacgcaucccucugccuuugacaggaugcuacuugcagacugcuuuucaggccuuagauuucaaaagcugagaaagaaugguuuucaagugucaacugaagaaggagaaggaggaggaggacgacgacaacaacgaugacggcaacaacaagaacaacaacaacaagcagcagcaacagcagcaggagaugaaaaugacccugugaaauuaagcuaugccaaagcggugucucggaguuccagaagagcaagaaaaaucacauuuuuuuucuaagaagggaguuuggcaugugguaaauagaaucacauuaauuaguuuaaaugaauuuuuaaugccacucacggagaacacaaguggaagcuuuaucaaccuagcguguaugauuucuaggauguccgucugccugugaaguaaguguguuuccaguuuacaaugugccugacgcucaguuaaugaacugcauuugcuugcugucugaagugaacauucacagaaacucaaggugaaucaagagguuucuugcauuucggcuugcccacuuugagauacuccuggucugaucuaagcaaaugcuugaaaccuuuagucuaagaaucugcacgagaaugaauuagacagugucagaugucgccguaaacuguucuaaguuuuagcaagauuccucuugcuuaaggaugugugggguuugcuuaggaaagucaaucgagcagguuuuuauuuuuugaaaaccaugaccugauauggaacggggcccacugacuugaaaacuuacagacaaauaaagucuucucacagagauggaucauaaaccaugagagucuaucuucgaggagaccuaggagagacaauauucucuuccaaaggauguuauuuuaaaaagaggcaggcugaccaagggccacaugaaauuuuaguagauuugggggccucauuucuggccucugcacucuuauuucauaucaucuuuacauuccccauucaugaaacuuaagguuucaaagaguuccuaaguucacaugccucccaaaccuucaacccugaacuuucuuaaaauccugaauaaaaacuccuuccuuccugcuguucccccuccuggcuccgccaucuucuaaguagaggcuuccccgacccuccugguggguccuguccagcgcuguaacaccacuggauaguuacaaccaccaacucuuggaugcucaccagaccauggcaauguuaaguccuuagcacccugggcaaucacaggaguggcccuguguuccuguccccuuacuuauugacaaauggaggcuuguaaguaggcuaacuugccugguaacuagcaagcagcucaacugggugugaauccgggguguguggucugacaggaaguggaaguccuuaugcucuaaccuccuggccucuacagagucaggaauucuguccugacuuuagauuuuuuuuuguuuugcuuuuuuuuugucccccccccccccccacacacacacaccugaucaggcugcguagaucaagcggugucugucucucaaaucgguuuucuuuuuuuacgguugccuauuuauuguucgagugccuuucuuauggcucuaaaucagcaugguggguaacagguggaagguuucuaaucuuucauauuuucuuccagcugaaggcagacaagacuuaaagucucuuuguuaacauuuaaacccaccagagaaauucggcaggacuuggaguuaacuccagaaggaaggacagauaggaggauuuaaaaacaaaacaaaacaaaaaaacccucuuuccuccuacucuauguaacccaguuuggaaaggaaaaggcagucuguccgugcagcaagggggcccugccuacaagggcugggcuaggauucccugaccaggcagcuguaugggagcaccccuucgagggagggaagccaaccuccacuaggucuccagcccccacuuccagcccugugagcucagcccagacagcuacaaacccucaagucauaccgugauauauauggagggcagagggucaguucuccucaccuuucaggugccaugaaaaucucuagauccaaggaaacacucugccaguguaagcaaggcaccuaaaaccaaucuagagggcauuccuucagcugccuuccuggggacuguacucuagcucgguggcuacggggaguaacugucucuuugaccuuggacagggagaaucagauugaugggugaagccucgguaaggaaccaaacaucuuccuuagaagugugccucucuacccuagcuaggacaucugggacugaaaccaaucugucaaaaacaaacaacaaaggccaccuggguuuggagagggaagcuuaggcauuggaggugcuggaccuccaguguuuaguacccuggagcagauagagcaggagaucagagacaggggguugguguuagcguauacucacaagauuaacuccucugacuccuaugcaaauaccuagggagggaaaggcacacaggguuauuuuaagcccuuaucuuaaguucuaaauugccaaaaccaaacaaacaaaaacggaaaggaagccuacuuggaagaggcaagauguaggccagagcaguugcaggccaagaucuaggaaaccguguuuccuaaccuagguaggccucccagucaacaagcugggacagggggcggccagcugauuucccuaaaaugaaaaugaugagaccugagguacuucggcuguggcugcacgucugagaccuauagaacagguuuauggaacagugaccguucacagagcagaguuggcuaagacaguccugguggguagccaccuaccuucccaucugugguacagaaaaccuuggggggaaacaaugggaaaaaugcuaaagaaaggaccaggccacuauuuugguccagaaagaacuuucccauggcuuccuugaaacaucaaccagccuggcgaacuagaagccaggcgucaggacuauggaagggccauugccacaugcuggugccugagguucacacuggucucuguucuuagccuggcuccccuuccuucuaaaucacaauggcccugucagcgucacuuuuucuaacaggccaagguauccaucccugucgccggccuguuuggaaucccucaauagucucguuaguuucugucaauugcaaccaagagaccugccuaaucagaaccacugaagguucuuagucuggaaagcaguguguucaggcuugugucacagaaagagaccacacacagcaggcacugacuacucccuuggauucaucacugcuauacauuacaacagguaaacaguaauugccaguggggguaaggggggguuaccaccuccaccaacgaaaaacugcccauggaaaacuuaauggagccuuucugcagcuccucuguaacaccaucuacagaguuucuaaucuucucugaauuacaaccagcagcucuccugcacacugggaacucaauagacgggccaaaugagaagcauuuaaagaaaacagcagaaaaugacagggauuuuaauguggcuccaauuuacauggugauugugugugugcuucaugaaucacuuuuaauuccugcuacugagacaaaaggagagaauuuuaccuugguaagugcuacauaaugggccaauuauguuauucuuucaauauaguauguuuguuaugaugcaaacacccaucauuuccaguauuguuuuaaauacugguagggaaaagagcuacguuggcuaauuuuaauaauuuucaauauucuucucccuuuugcuuuaaaccaauaauggagaagggaaauagucuuaaagauuuauuuauuuauaauguguaugaagguuugccugaaauguauauaaauguaccauaugugagccuaguacccacagagguuagaagacagcgucagauguacuggucauuguaagcugccauaugggugcugggaacugagcccugauccucuggguugaacaguaaacauucauuacugcugaguacaucuuaccagccccagcaaguaauuuuuuuuccaauuuuuuauuaggcauuuucuucauuuacauuucaauguaauaugguacuguuuucuuuaaaugcuaucccgaaagucccccauacccuucuccuccugaccccccgcucuccuacccacccacucccacuucuuggcccugguguuccccuguacuggggcauauaaaguuugcaagaccaaggggccucucuucccaaugauagcugacuaggccaucuucugcuacauaugcagcuagagacacgagcucuggggguuacugguuaguucauauuguuguuccaccuauaggguugcagaccccuuuagcucuuuggguacuuucucuagcuccuccacugguggcccuguguuccacccaauagcugacugugagcauccacaucuguguuugccaggcacuggcauaaccucacaagagacagcuauaucaggguccuuucagcaaaaucuugugggcguaugcaaugguguaugcauuuggagcccagcaaguaauuuuaaugauauucuuuagauaguguuuuuaaugcaguaucauauuuagugacugaaaacaauuacaaacgggcuuggaaaaaauuggucuuucacaugucaccaggccacucaaagaacaccgugcauguuaugacaacuccuucuucuguguaagagguggauggcuuuagugugggcuucaacucagaaaaacaaggacagacgcaagacugaccagggagagcugaguggguaggcgacugacagcuuagugaaggcauguuuacugugcagaggacagaggagauccagaugacauugaagacagaggucacaucaggagugacagcaaccuuagagggauauguaauuaaaaaagccagaagaggcaccgcuggggaacugaaaugcuauguguggguagguaaggaacacaugagcucaggaaugucucugucacaugucacccugucacaucccagccaggggucaguccugaaguguucucagguucagacaggcaauaagcagcacacugaagaacaguuaugggaucagaucccaugccuccugcauucugccuagccccccuccucccaggcuuccugggcugggaaacagugacaaugaucuaccuaguuagagugcaagccccuuggcagagaguugaugugagaauaauucagcaauugggugugauuuaggguccuaugaaaucaaaguggcugcacaggauaaaauucuuccucaguuuccacuuggggguagauaggcagcaaugccagugagaggagggggggagguuuuauucuguauuaucagcauaucauagaauuaaaucaucucaacugcagcuuuaucugucucaagugauaauuucagucaagggaaagucuacagaacucuuaauuaaaagccuggucaucuucuuagggaaaauaucuacacaugacacucacuaagaaucuuuuagaaaggaacgauaucagagguuggccccaaaagggacauugcccuaugcuuuuaaaugccuccucuagaggggcugauggaggcucgcaaacuuaugaaggcaaaaaaaaaaaaaaaaaguguuugauaauacgccauaaaggaacagcaacagcauugaucagguucaauagaccaaucagguuuuccuaaaauguagcauuugcaguggaagccugguuaaguaguuacauucauaggauguacagagagccaucaauccccauucauccagccacauuuacugagccaagaacuuugcugggcuugaagauauaaaaaugaauaggacacagcugcuuuaccucuagcuaaaagaauacaccuaaacaaagagcucugggggacguguuaagugcugugguugagguaugcacaaagggcuggggccaaaggagggagccauaaauucuuucugggaaaucaagcaucaggccagugagggaagagagcuaagaaagggugggguauuuccuugccauaaaccagagcuccuacuuuaccauguucugaaaaggaagguaguuaauuuuaagauuuacaaacuauuguuacuccaggagcuaucuccguccacugucugucgcauuuguuuccgacacacucugcggacauucucagcaguucugggacuagaaaaaaaaaaaaaacuccaugauguguaaucauuguaucccugcaauaaucacaagacagaauggguccccgccaugaacuuagaucucaaguucaaagauguuuugaaacaaacaaaugaaaaacaaacuuugaaggagccagccaugccauuaaugcuucuucuugguggaaagaaaggaggggaucaccugauuauaucaugguucgcauuugucuuucugucuggguuuuaaaaagagaagggcacguugaauggccggcuacuugccgucauucauuaugcauaccauauuccuacuuauagcauaguugggacaaaacccccauuguucauuacacacuagccccaaacuugagucauucuaauguaagcaugagaaacucccggcuccuuuggggugaauuuccaaauuccucuguguuaaauugaggucuaauuuuuccugugccugguuuucacaagaagguccauuccaccccaugcgcucccuuucagcugucaauaaacagaggcagugaauuccccacagcuuuacaaagcuaguuaggcagacccauucacuccuucaggaaaacagcgcauugauuucagccaguucccagggugcagcaggaacaaagagaucaaaggcccaccucucucucccucuaaagcuuucauuaaggcccagcccagacaaacugcgacaggucuccuugagaccaggagagggccgggcagaccaccucaugguucaauucaaauucaucuguuuccuacauuccagugacaguccagaaugcuaaccgugacaaaacgauacaaucggcuggcauaauauacugcucacuaguucauccaaggucagggggagaagagaggccuggaggaaaguccuagguuucuagauccugcugggccucaauggcucccugacauuccauaaauaaacuucuucucucucgcucucccuuucuccuuccaugguaucuuuacgaauggugauccacuuaaccgucugaaauuucuuuucuccacugaacccaaacucucuggaaaguuucuucccaaccuaacaguuguauaggugugguggaaggucccccgaccagccccuuaucaauccacuccuguguuccagcaaagccccuacacuguacaaguuccugguuacuucaagugaaaaguguaauuucuaacuucuagacguucccgaaggcaccguccccagggaaggccacacagcucagagaagaguauaguuuguauaaauucuguuugcuaaacagaaauaggaacaggggcgaaacaguuaccuuuuuuuuccccuuuaacuuggggaaucuagcuggguagccagguccuaaauaguggucucugugugaaggaguguuugcacguuugugggagugaagagggcuagccaggggcagggcgaaccaacagagucugaaagaaaauauguuuucccaaggggggguuaccucuauuaaacaaacauaauuaaaaggguuucuaaauuugcccuugaauucagaacugcuccuuugaggcgaccuucaccaaacccuguaaugaaauguguucgugucugucacucauccugaguaaacaggagagauggcuuaccuuucaaaauuccuaaaccgaagagaaaauaaacaauauuggaacuaaagguauggaaaacccacuucuugaugcagaacacacccuucccacaugcccaguuccaagcuucaguacuguccuagggcucaccacagauuuccugagcccugaauucacugauucuugucuaucuuuaacuacuacagagguaccacagagaguagucaacagcccucugugaaaggcuuccacuuauuuucaagguuagacaggaaugagcuuuaaaaaggccaaaguggcgauugugauagcacacgcugguaaucucagcauggcccucagacgcucacaguguugggucacgaguucaaggccaacccuaggcucaauaacgagagccucucucagaaaacuaaagaaggagaaaaagagacaaaaggggaagggaagaagaugauaaaggcagggaggggagacaggugccugugacaaagacaagugacuguuuuaucaagaauguuaagcuaaaucuguccauugacguacuuuagguuaagggguuacacuaacaucucuguuuuccuagucuucugaaauggagacaaaaauaucugucaggaauuucuuuacaagguacugugaaauuagcaugccuccaaagcuugcucaugacaggaagcuggucuuaugaucggcgucacauaauugcaggucacucugacucaaacaagguucucuggaaacucauuaagcuccucuacaucaaauuauuuuucagaaguacucaugaaauuuacuacuuuaagaaagccuguggccagggucaaacacacucaugggcucacuuaccaaucuuucagaagcauuugcaaagaacugcgauauuacaacuugauccuccucuuacaacugacugaggcauuaugaacguguuucucagagaggagaaaaugggcucuagcaaggugaagagacuugccagugucauacagcaggaggauggaaacuccaaguguucagucuucagaucucacacugcucccauuauacacagacgcucuguaccauggauauaauuauccacugaaguccucuuuccccaacuacacugaauaagcaaucauguuacuacccucaaaauaauccaucuccuagcauuagggauccacugaaaaaggaccuuaaaaauaccaaucuaugcuccaaauaaggaaaauaguuuaccccaggucauaagauauuccuuugggauaagugaaggcaagauccugggaaaggggauuaaaaaaaaaaggaggggaaacaaaagaaauaaauaaauaugaacuuacgaagccgauggcacgcugaagcaaucaagcaggaacaaccugaaagcaaacaaagaguacucauugacacaacaguauucacacaacaguugggcgugugccuuggaugacaguaaucuugagacuguuggagauccgaggucacuuuuaagacagccuugacuuaauuucccccagcaucaagauuuugcaaaacuguauauuauguuacagauaaaaugcuguuaauacaauccagagucuuuuucgaugucuccaguuuuauuggauguguccauugacuuguauacauuuaucacaggcucauaucaccaccaaagucgagauauagagcgaguccaccaccucaagcccccccauaacucccaauaacucccaccaucaagcucaugccugcuucaacauuaaacaugaguccaccaauuaagaaagaaaagacaccucucagacuuaagagacugcuaccaagcugugcauuaaagcaugauuaaagaauucucuuuguaugcauugggauaaguuuuaaagucucuuucuucucauggcuauuucaggauaaacaacuuauuuuaaaaccaaacauggacaugaucucuuuuuuuuuuauuagauauugucuucacuuacauuucaaaugcuaucccaaaagcccccuauacccuccccccacccugcuccccuacccacucacucccacuucuuggccauggcauucccagguacuaaggcauauaaaguuugcaauaccaaggggccucuucccaaugauggccgaauaggcuaucuucugcuacauaggacaugaucucuuaauuugcauuccauauuuucaacguagcucuaacaagaaacuuuuagauauuuaccauaggaucaaguaggucuuuuccauauuacuuuaauuaguauacauauaccacugaguggcccaagaggaaacuaagacacugggagggugaauaaguuauauacaauuauacuagcaguauuugggaucagacaauuggcguccaggcgcaaaugucccucaagauaaucaauauuaaugacaucaaaauauguugugcuaucaccacaaagcccccaauuauugcuagauuucaccuuaauauagagaaacugaauaggaaaaauguccccgaacaaugauacgaguguuuuguucuauucugucuuguuuuguuuuugugagacaaacucacguucuauaacccaaaguggccuggaauccucaauuauguucagucucucaaguauaugcagcacauuaaccagacuggaacgguaauuuacaaaaugaaaauuguucuguauucaaacaugaaaugauggaaaauggucaaaacaaaaaaccagaggauggagcacacaacaaaaagaccccuaauuagaacaacaaaccaaucacauagccacgcugacccuugaaaaaugcucauucaucuagcaaaagagaagaugagaagugaaauuuucagucacagacaaaaagcuucaaaauuaggcucuuuagccaauagauacaucuaacagccuaaagguaauauccaaauaaugauaauaauuuaguaggauacuuaucaggacaaaauuucuguagguuuuauuaucuuaaugauacagcauuauuacugaagaauagcagcuauuuucucuugcaaaacaaagcaacauauuuauguauaacuguggcaggucggccaacucaagaauacuugagaggcauguagccaguaagccacuaauauccuguuccagauacucaggguaugcuuuguuuacagauguucccuuaauggucuagggucaggagguggccgagggaggcggccucauuauuagcauagguggcugugcauauaaguuauacauaaaagcaaggggguggagugaguuucacuuccauaggaaguugccuauucuuguuccucauuguaagggauggcgucaacucuaccuuagccacauuuuaaucuaucaguaguucuaaaaugcuuauauuuuauuccauuucuagaagccauuauuaguucaucuauuuuaacuagacuuuauaguaccucuagguuacucaugugcacuuucuucacugugggaacacauauauacacugaacacuuucacucugccaaccugcucucaccaagacuccagagacuggagcuucauaaugcucccccauacuguggucauuccauacauuucuucucuuccagcugccauucccaucccuaaagcuuggacacauguccaucaacacccuugccucauggaucacugagaaaacaaaagcuauugcagaaggcaucuuaccuucccaacucuaaauauacagacuucccuccagccacaggacaacaucuuccuagaaccagaagccauuccccaccucucugucuagauauuucucuauguuuccaaguccucccuauccaguaagacacauauccccacuauucaauauacucugguauaucccaacuuuaaaagcaaacacaccuugaccuaauagcucccuacagcucugcucuacaucugcccuuucucugagaaacuucuggaagguugccacugccuugcuuccuacucgcuucccaaguuggcucuucuucguaacaccuuaucagaggauaauuauuaaugcaaucauuuuaaaagucaggaggcugccgauuaagagagauuauaaggcugugagugaaaaaugccuguuuggagauacucaggagcccugguccuucccaaagcacucaggacaucagacuaaggacuucaagaaccuacaccuccuuccucucuuacaucauccuccaugcagaaaacccacagacuuacaccuuagauaaucacuacucuucauuauuuuuauuugagagaggaauuacccguaugucuacauuagcuauuuguguaacuuaauuuucuuugacaaccugaagaauuggugguucuaucuccuugauaaaauucagucuuggcugaaaggaaauaaaaauccuucccagcaccaccuuaguagagcaggcacuugaccuugaucaccuggauucagggacccugcgcuuuguaauagcuccuuucucuuaguugcccccauuagauggcaaugugauaagggcgccauucugccuuauaugacccagucccauuaccuccaagagauaagagaauuuagaguugauguaaauucauuacaaagccugaaaaacuguuuuaucuaucacaacggggacuaugagaauuuacauugucaagauaagagccucaguucaggaucaaagaauguagcuccccuggggcucgcucaaagcugacuuagcauuacagagcuuggcacuggccuguaggucaccccacaccuuacucccauuuguccaggcacaaagagaacugugcuuccucagaacugccacagggccugggugaauaugaccugccucugauccacucuucuugcuggaccuucuccagcuacacaaucucacugaagagagaagucccgggaucuaugggagauacuaaccacucucgacuauaugaaugccagguucauaaaagcauggauucugucucacaggcaugggcuggggugggggugggggguguugaggcaaggccaucacuaguucaaggccagcuuucaguugauagagaaugucuagaagauugugaagagcauaaguucaagaaaaugaagacacgugauaggggaaggauuaaauaaagacuaagcuccuaaaagaagccagggagacccagacagcuucauugaagucuaagaggaaccacagauaugagacaggaaaacugcggcauccauccgaggaccauaccgcaaauggaaaaaaaaaaagaaaagaaaagaaaaaagaaaaagagaaagaaagaaaagaaaagaaaugaaggguaugcuucuuugcacacaugacugccugaaaacgcaauauauaaauaaauaccuaagaagccauccacguuuggaagacuauugugcugccacagacaaaggccucucaggcugaaguguuaaaaugacccuugggcccuugcauuuccacuuguaggaagugaguuaaaaaaugguucauccccaagugagguaauuucucuaacccuaccucccacccaugacuaagaacaggaagaugcucaaaacaaugcccagagggacucggggcccaggaagacacacuuugcuuccuuugggguauccugucucaaacuugcugcacuuuagccaaugcacuguugagucuaaacuuagguuuauauaaacaaaaccgcaggcuagguuugaaucugcauuacuuuuauaauugcaaagagauaucaggagucccuaauuuuccuguauaucacggauuucaaagccuaacgcugaauggcguaucacuauguucuacaaggcauccucaagggcuacaagcaucguccaugggcuuuuaggaagcaguucucuagacugcagcuugaaaugucucuuuagagcgcaacaaggcauuacgcuaaaagcaugcgagcaaggcaggcauacuucacagaaggccggccaaauggucagcucuccgccuuacacagcucucagcaucucaaccaggagccauaauagugguguuguaaacaaacaaacaaaaacccugacuuuacgccuguuaagauacacaauggggaaugagagacagcauuguaaacacguaagcagcuugucuccauuucaacauuuuccaccugucgauggcucagguacaaacagaacaaguccaucacaucuuuuuguacaaccccagcuaagacuacaucuagagaccccacugguccagaaggguuggguccuauuucagagguccccaugcuuccugcugcugugacccuuuaauguaguucccaaagaaccacccaagcaggccccaauucccuugucaucuacuaggcccaggugaugcuucugguggcuaggcagcugcaugucaccauuccaaagcaagugacaaauauugggauauuggcagaaaccaaacacaaaaaguuaaauaaaaaaaaaaaaaaaaaagauagcucaaauauuuguugaaagucagcaagacaaagauagaaaaacccagaaaguaggggaaacugggcuaaagguggugugugcgguagaguaccugcauuuucaaggucuuggguuugaaaucucagcuauacaaaaacaaguagaagauugaaacaaugaaauauggagugaggugagguuuuucccguuugucugagcccaaugaagaacacugaaaacuuauccauuaggaacaauaaaaauuagaagggaaaucuaaagaaagccugaacugguuaguccacacaaucagcguggucucaaaggucagaguccaagcagcacacugacaaggaagagagaggcaccucuccaugccugcuuuacuguaaauauuucuacucagccauuucauuuauuuagccagguauuuuuagcaccaaggcaauacagccuggacaagcaaaagcuuucaaaucggucaaaccagucuugcaacuuacuaacuauaagguguugggcaaguuucuugcucucuuugcugaguuucuucccaauuggaaacagaauuaauucuacuuaccuugcaaaaccaagcccaauuaucauggguauuuaauagugggagccauuuggcaaucgugucuuauacgguaaguaccaugcagggcguuuggacagaaucucuaagaaccugaccagcuggaacugacauuuagauuuaaaagaaaaaaggaugaugaaaccuaacaauuuaagcauggaucacaaauaauaggguucugaucuagcgagaaggauuauuacauagccucagaacaggaccuagaaaguuuggguugcaaauuagugggggugaauauacuaaacauaggggaaauggcaaagggaagaacacauccauuagcccaguagaauccucuggaauuggugugagguggcgaccaccugaccugagggacucagucuaagaagcagcagauacagagagaccagcaaagacagcugggggugaacaaggagggaccacggccaggccaggaacaaagaaccucuuuucacaaggacugggauucaagaaugucauagcaaguggucauuccucaugaugugaagggcaggaaacuguacagcaagggaaauuauacaggacaaccagggccuaaagcuguggggcugaugagaaugaaaaaacuaggaggugguuacaaagcuaaauuuuaucaauuaacuagauuagugagucuuccuaaauugguacagguaugcucaucuuccagucaucacuauaauacugacugaccucuaaguccucacggacauggauguauucaaacaagcaaaauacauugucuggcaugaaggugcucaaaauauuguuggugaaugaauauaugguagaaauucuaaacacaaaauuaagaaaucucaauguauggcuaauguaauacaagcuaaacucauuuucccuuucuguaguggggauuugccacaaaacaggcaaguguugaauuugugcaugcaaaagcuagcuauauuucuaucuuaucaaagacucagauaaaaaucacucuagaaagucuggaagguugcccugucaguugcuaaggucuugugcaauacucuuuuaggaaucuaucauucauuguguucuuugcuguagucaaagaacaauugcuuuaugauucauaaguaucacacuagaaaguauauuaaauuccaaucauagauacaugcccaaaguuuaauuaacaugagcugauuugaugacuaagcaauaauuagaacaaaguaaucuauuagauucuaaaaaagucaaaggagaaaauagauugaaugugaccuagagaagaggaacugucauaacccucaccaguauucucaccaacuucacaggagagagucccacuuuccguauuuuauggaugggaaaauuaagaagcugagaagcuaagcaauugcucaagauuuuacugugccacaaagggauggagcuaggaaagccacugggcucugcaauuuaguagauuagagagugggcuuuauaacaucaguaucguucgugaguccgcagcacugagcaccagugaggcacagcacuuccauuuaauucagacacaagauaagaacauccacagccacuauggcuaaggcuugcugcccuagccagugaaaaaacacaaaggaacagaacagcacaugaccauuaggaaaaauaacgaguaagugccauuucugagaauguauaggacuauuuacaguggaggaacuggcuacuuuuagaaacacggaaacaaagggaaauauacauugugagauuauaaggauccagaggguaccuaacaaagugugcauguguccucuuuaaaggaccagucagggacauuuuuaaaaagucaggcggggugaauggaaugacuaguaaguuacagauacauccauucuuuuaaaauuagccuauaaguucaaaacuaucucuauuuuuaaaaaaccccaagaggguccuucauggagaacuggcacuaaaauucuuguagaauuuauauaaaauucaucaccuuaucacaccaaaaaaagcaaguaugaugacaucaguauguagagaaggcacuggacaaguuugagguuggguacacauuuacagaaucaccacggagcuggcuuagaaacagugagagaucagccaaaaggggaaccccuagauacuggcuucuaaucccugugcucaaggaaacagaaccagaaccugaaacacagucaguucuaaggugacagagggacauaugcaugaguucacagcauugucaaaguaccuccaaagaguuccuucaaaauguuaacuacuuugguggcuuuaacauauaucuguaaauuauuuuaaauucuucucaucucuugaauuuggacucucuucuaacaacgagaauggauagcagggaugugguauaauaaugaaaaacauaacugaaaccaugguuucugccuaaccaaacaacuacacgguuugguaaacaucacuaguugauguggauacuguguggccccagagaagauacaaauugggaggguaaauaccuugugauauuugacacccaaaucuaggccauuuacauaauugugaaaguacacaaaucuaaauuaaaagguagucauaacaguaggaaaauuacaguuaagaagugacagaagaauaauuuuaugguauguaaguagaggacguacacuacaugaauuauauuaaaggguugcagcauuaggaaugccaauguuaauuuacuuuuguaaauguauaguagaucuauaagacauuaacacaggaaaguggguggagaguauauaggaauacucuacuaucuuggcaaaucuaaaaauuuuauaauauuauauauaauucuauaauuuuuaauuuaauguuuaaauuuacuuuuccaaucuguuugcuuuuucuugccuuacuguaugggcaagaaccuccaaaacucauuuaacagauauuuuaaggcuagacaccuuuauaaaauuauuuuucucuuuacauguagaauaauuaugcauuuaggaaauccuuccaaaaauauaggcuacucaaauaaugagugauuuggcaagacaaugagacuuaauaguguguaaguccucuacauaguaaccuacaaauaacaauaagaagacaauaauaacaauaauaaucaaagaauuuaugaaacggauaugcagucuauauucauuauuaugucaaugaacaauuuccaaaaauuauuugguaaauccagugcaauaaucauaaauaaaacugugaaagacucuuaaaauggacauccacaagcucacucuaaaguuuauacgcaaaugcaaagaauuucauugaaaguuaugaaaaaaauccaaggguggaaagacagaccaguggguaaagugcuugcuuacagccaugaggacuuuagaaccccaguacccacauuaaaaagugaggccugucaccuuaguacuguggaaggagagacaggccaaugggcagggcuugcuggcagucaguccagcaaacggugaguuccagguucacugauccugucucaaauaccaagauggagacauaugcugaccucuggccuucauauuugcccacauaaggaaguguaccugcauauaacacacacacacacacacacacacacacacacacacacggggaggggaaauuagagaagccacaagaccuugccaagggcuuuaggucuagaaaaguagccuagugguggaaugaaugcuugucaaauaagcacaaggcucccuuuuuaaugccuagugcaagaaaacaaaaacaaaaacaacucacuguaaaccacguuaagaucgccugauacuaacuugagaauugaaaagcaaucuaaguggaagagaacaaguucagaaauagacccaauugcaugaucuuucguuuuucuacaaagauucugucaucauucaauaaaaaauggauuauuugcaauuaauuuagauaguagugacuugcccacauggaaaaaaucaucuugauccugaccuaacacauacaggaggaucaaauagcaaugaucacaaguccacugugaggacuaaaaaaaaaaaagaaauucagaccuucucauagaggccacagacaaaugagauuguaaaaucauauaugggcaagacucauagaaacacuauuacccugcuccccacccacaaaacacccugauaaacuggacuucauagaaguaauacugcuuaucaauuuaggcaccacuaaaauuaggcuguguauguaacucgguaacaaaacaauuuccuagcccguaccaggcccuaaacucaagcuuuaacuuacaugugggcacacacacacacacacacacacgcacacguacacaaacacaaacacauacaggcacacacauacacaaacacacacagacacacacagaugggaauaugagagcaugugaggcaaaugacaaacuaaauuccagaggcaaaaaaauauuuauugacaggccagauggcacacaccuuuaaucuuagcacucuggaggcagaggcagguggaccuccgugaguucaaagccagcuaauuuaauuuacauggggaguuggcagcaucccagaucuacacagggaaaccuugucucaaaaaauaacaauuuguaagcagguacccggugagucgcccuuccagacuguauuaggaauuaaaaugaacaaaauuuuuaaauuggcaagauauguaagcaggcacuucuucacagagaaucugugaugucccagcccccagaggcaggggugggaguuuaaaguuggccuggaauacauacuaaguucuaggccagcaagcacuacccaguaugaccuguccuucccccccccccaaaaaaaaguaaaugccacucauuauaaauaugacaaugcaacaaaccuacagaaauaaauucaacuucuugggcugugcagauuguaugucccuuagcauuugauauuuuuaaaaauuguaauaugcauaagauauuuuggagugggaccuaagugugcauauaaaaugcacuuuauuuguuuguuuauuuacuuccuuauuuguagggcuggguauugaacccugagccucaggggugcuauguaagaauguacugaguuguauagcccccucagcuaggggucauauaugcuugauguauaucauaucuauauacuauucuuauuuacuugcauuugacugaaacuuaccauuuaagcccaggugugggauuuuccacuuguggaauauugguacccaaaagcuucaaagauucaaaaagacuaggcuuuaagauuagggacauucaaucuguaacuaagagacauaucuccaccaaugaguuccaaaaacaucaggggauggagauauaccucggcaguuaagagcaaacagugcucuuuuucacagccuaccccgcccaguucccaguaccuacugguccuucagcuccagggcgaucccagcaucuccagcuuccgcagguaccugcacuuaccuuuguggaacgcggcaaauauauacacacauuugcauaauugaaagaaaguaaauucauuuuuuuaaaacaaagaaaaagcauuauagcaauuuaacuuguaacaguccaauauggaaaacaagucaaauguucauaaaaaaaaaauguaaaauggauaaaguguuugcaauguauacuggagcaaaugaacuucccccuagcagccagaaaguaaauaccuuaggcuuugugggucugaugguuccauagagaaacgggcuuuggcacuguuccaauaaagguugcuguaugaaaauauggaaugggcuagaauuggcuaauaagccacaguuugccagucccguguauaaagggaaaacaagcaaaguuuugaugaaguauuagauggcucucaacaacacaaugugaacccaaaaaaguacauuuuucaaguucauggugacuggagucaggacaguugagugggagggugguccucacugggaaggggcagggaugcaaaggguuugugaccacaucuggcuagccucacaggcauuuccaugaggacauugcaucaggccacacccuuucgucuuugcccuuuccgcgguuuguauuuggagcuuguagcucaauuuagagaaaggagcaaguuugauggcuagcauguggauccaaagaaauaacauacagaauucaacauggauaaaaauauaaaugccagaauaaaaacgugugggaaauuuuaauguuuaauuuaacuguggcuccuagaaaaaagugggagcucaggggagaaugaaaucaaggguaaaacuucccaggcuugaaaaagaaaccuuagguaaaagucucaagccacacuuacgcacacaauacauauauuacuguccccagaaagccucugauuucguguccuucaucaugauacaagcagcaauuaagacacuaaagccacucucaaaagcaaacaagauacaugugcuaauugcagugcaaaucaagauucacuaacaagaggggaauuugccaagcccuccacguuggaacuagaguauaccucucaaacagggaaagacaaaaaaaauuccauaaugaaaacaucuuuaauucuuaaacagaaccacacaguaccuauaaagcaacaguguauaaaaaacuguaauauuuucagaugacaaauggguacagagccuagaagcaagcccaaaccaauccgagcagugcccauggcagagggggugcaccaagucccuggcacagagucuucccaaguuaaaaaaaaauaaucaaaucaaaucaaauguuguuuaucuuguacuaucuccaccacauaagcaaagcauacacaucuacccccacaaguacaugcguuccugaacugcuggcaagauacaaacuggaaacacuuuaaaaaucauuguggaaucaauuucauuaacagccaaguuuuucauaaaaaaaaaaaaaucaagacacacaucacaaagaugaaugucuguuuauuaucugaaaguuucuucaaccaugaccuguauccagaacaauguuucccaagagaacugucugcaguguuagaaauguccuggucuguaauguagaagcguguaacauaauaaaauauaaaguuauacguggagcacaagaaauauggccuggagccauggaauaacugaaguugaaauaaacacagcaugccagcguuuuacagccuggagugagggguuacaaaauccaugugguuuguuaccucugcaguuuuuacauuuuuaauaacaaaaucucaucugagcuuaauggcuaaauaaaauauguccaaccaacaccaaaguuacuuuuuaaaaguguacacugaaugauuucaauuuucuuaaguuuuuaaaaaauauauuaaaauguuuaauauauaggaaccuaugauggauuuaaugaauagcaaugugcccaccagaaaaauaaugaaauaagauguuaaugcuguuacguuaccuagguaacucucccugaucuuuaugacgcaauggaaaauaugagauuucaagccuuguauuugggcuucuucccuuucuuuaauauacugaugauggggugggguaauagaucuacauguaucauugauaguuauuaauccugaaacauggcucaggucacuguccaguggucaggggaugaggcaguucccagaaucacggggauucuuaguguucacucacaccuucugaccccuccuccuccuccagggaggccaccacggacuugacguuccuagcauucauuuacauuuuucccuuuaugacuuuuaauaacucugugggucccuaaacaauagccuugccugccagguucugaauuuuacauaggugaaaucaugcaauauucaguaagguguuuucauuucuuccccucaacacugagaggagucuguacagaaacacaaaacuggcuuauuugcuccuauacugugcucccuuuuaugacugguacauaauuuauguuucccagucaggcggacaugaaggcgucgaccagcuuugugguacuacacaguaaggccuguuugcuguaccuguucucuggugcauaugaaaauuuaucuagggcaguggcuuuuaaacuuuuuuugaccauagcucagaguaagaaaugacauuuuugaagaacauuacauacauuuguguguauagacggggggggggggggggcacauaaaacaaagaccccucugacuugagacacagucugacacuuuaaaauucucaguuugugguuuucaauuucuuaucacuaucuccuuaaaugauuucacaacuuccaaauacgggcuucauguuuggaacaaugcgcugcuccguguaguuugaggaacgggacagcgaggucggaaaaugcaucugucaagugucgucaacucugauuuuuuuauuuaaaugaacgugcucauuuauuaguauaaauuuuucccacuguaucagagcaaaaaccgcaaaacaacacauuuuaucuuuucauacgucacuaaaauacuaaucacuuaccacacgccaaggaagcaggcacagacuccaacccagaccuauggauuaaaacgcagagagaaggggaaagaaugggggggggggcgcuucggggagcagcaccucggcgaggccccagagagcuaacagccgcugccuuggagggcgagguuagcugaagauuccuagaagaagaaucuacucugggacauuucuauuuuuaauuuuuacucgauuccuaaaacaccaaaguagcacauuuguugcgaggggggauucccaacauuuuuggagccuuuuuuucgguacaaagccaaaacccuuacuagcgagcgaccuuaaaguugauguggagacuggagaaaaguacacaaguugcgcucugaauucucccaggaauucuuaggaguccagcauuuucaaguaacuuuaagagcacaagcgacaucgcucaguuauuguuaaagcauccgaauaagucuauuuuccccaaaggaacacaaaucaccucuucccgacuuuuuagccuguuagcgauuuccaagugucgccagguuguaaagaccgccacuuaagugccgcauagcacacgggcaggacacgggugaaagcuagcgcggcacgagugcccauuuggaucgacccggagccuuuugcugcaucucuggcugcaacuggggcacccagguucagaguuuaucaccucggagcccgaagggcccgggaccccguggucugcgcucagcgcggcaacccaucccgucgcggcacggcuaugccacgcaauggccccgguugucacuacuuaccuacccuagccggacucaggcgucgccgucagaucuccgaucccggauccgcgauccgcaggcaggcgcagccuaagcagccaugacggcgcccaggagaugcccgcuugcucuccagucccgauagccgcgagcccggugcccgcggccgcaacuccccgagcguucucccgccugccaggcgagugagguuggagaacgccccagccccggcuaaaucaaggcucggggcgguccc

SEQ ID NO: 12451 - RNA, 47603 nt, Mus musculus
aaaacaagcccgagacccgccuuuucccucgggcuccuccgcgucucgcucugcucgggggcccguugcgcccgcgcggcugcgagccucggguggccgcgcguggccgcgccggcuucugccgcggagggcgcggcggccggaaugucgcggcgagggccgcgcggcggggcgggcgccugaggaagagcggccggcccgcgcucuccguggccgccccggugcggcgggggagccgccuucgugggcgccggggaccgggacacccgcgagcgggccggggagaugcccaaccccaagaacagcaaaggcggccgcaaaaacaagcgcgccaacagcagcggggacgagcaggaaaauggagccggggccuuggcggcggcgggugcgacaggcgcggcggccggaggggcccuggcggcggcggcggcgggcugcggggcggcgucgcccggcgcggugggcaccggcggcgcggcgggcccgggaggugcgggcacgggcgccgccaacgccaccgucgcugcgggggcugcagccgcgggagacgcuaagaaugguaagacgacagcggcggggcgagcgccaacuuccucaccgacgggcgggcgggcgcgguggcggggcccuggguggcgcgggcggcgcguggacaaugcgagucaggaagugcucgccccgccccaccgccccgcgcugccuuuccuuucgugguccccacgcggagcggcguggaccggggcugcgggccccgcggcggcgcuccgguuggugccugcuccccguggugcccgcgcgggcugagucugaaaugucccggguuggugggagcgaggcagcgggcaagcaggaaaaggagcccaaguuagaaugauccgauuggaaacuucccugcucaccgcgacccacccacccaccauugcccccaaagaagaaaagcugcaauucccagcagauguaggccuguugccugauugccacagguggagagagagagagagagagagagagagagagagagagagagagagagagagagagagagagagagugugugugugugugugugugugugugugugugugugugugugguguucauuuaauucucuugucuugcucgaggaaggaagagaaucugaacuugacuuccguucccaaccugaaguguuugggugucuuuuucuuuuuuuucucucucuuucuuucucucuuuucuuccuuuucuuccuuuccuucuuuucucuuucuuucuuucuuucuuucuuucuuucuuucuuucuuucuuucuuucuuucuuucuuucuuucuuuuccugucccuuguauaauuguuucacauuuguuuuucugaagaagcccugauaauuucaugagcgcuugaaugauccuuuagaagggaggaaugcagguaauagcuaaggugugacaggauuuucccuucuuaccacaggaugccugacauuuauuugggcagcuuuuaaacuuuuuucuucucagguaguuuuucaggggaaaaaaauguacauuuuaauguaaguagaugagaaucguuagaaucguuauauuugcuucuuaacaguuuucaaagccauccucuauguagauggucucccauaaaaagggcuacaguacuuacaagaaugccacagugauucccauaggagauagacuacaggcuguuggaaagggccccccccuggcugagccccugcaguuuugaaauaggaagauuuguuuauuaggaggagcaaacuuacacguuugugaguguuugauaguguacuaucaaaacuuggcuagccuauuuggcuagccugugccggcucuugcuuucuuaucucuaaccguccuuuugauauugaugugacagagaagaugauacuuagacugcauaauaccagcucuuccucagccauuuagagcuuugauaucuggagaaaggccaguuuuucugaaccucaguuuccucauagacacacuugagggagugagggggggcagugaggguuacacugggccuuuagaggauuuuccugagggaggcuuagagugacccuuuacuuuuaaguucccauuucguguuauuuaaaggcuuauuauguaaaggucgauaaaagcucauugcaaauaauagauggcuggugaguaacagcuacuaguuauucauucaaaagauuauuuuaguuauuagauuauuguuauuaaauauuaaaauaaauauuuuaaauggacaacuuuuuaauuuguaauguuaauaguacuguguauuagauagggacuaggcuaaugguuauacuuuaguacauccucgguucucacaaagaccugugucuuuaccacacucugaaagauuugaguaucuuaaaguaguugaggaaguuuuucuuuggcagaugguaccugcuagacugaaaacauuaagccacuuacauuguucauuugaaguaguaaacugguagauuuagcaguacuguguauaucuggguaaagcuauggcuuucuuaguaggucuuuauucuauuagaugugggaaaagaagcagugggcccccauauugccauagccacaaucucagaagcugcauauucaggagcagcgagcugaggguuguggcgccuaucuuuggugucaccuuggugaaauaguuugauuuaacugaagaaucaucucuguguuucugaagacaauuuuaacauagguucuuaggccuacacaaaaugaauaaggagauuguaaauuauguguguguguguguguguguguguguaguauagauguagggagaggugauacuggugaauuuuuauaggaaggggcaauggacaugauaacaaagguucauuuuguuuuuuagcugugugcguguacaaauagcauacuuuuuggggucaggaguucucuccuuccccagguagauuucggggauugaaguccaguugucaggcuucgugguaagcgcuuuucccacugagccaucuuguuggcucaagacuaaauuauuuuuuaauuuuaaaauuauauuaguuggacugcuuuaugauuccuaaguauauuguagauuuuauuauuauauaauuuucaaaauuccuaaauauuuacagucuuuuguugguggugagacagugccuuagcuguauagcucucaggcuggccuugaaauguuuccuaucuauuacaauuuuacaugguuuguuuugaucaaguagguuuugaauguacacuuacauguaaacuuaaugacuaguagguguuucagguuuauagagugguuuuauguccuguaaguauggggcauuguaguuaccaaagcaaggucguauuagcccuuaguuguucauuguuaguguaaauaacuccucgcucuauaaaguuguuagccaggggaagccugaggaaacugguaugguuggaguugagguaguugaacugguugcuguuaugcaguugaauaggaauucaaaggauguuguacucguauuuuuuagauacuaauuuaugaagccuucugcaaggaauggaggaagcaagccugaggaaguaccaucguguccuacauaguaaacaucugugcacuacugcagcauugugauugcagguggacaggauuugucacucauucuuucuagacucuaguaaucaggcagcggauuacaacuggguucauucuaaaaggcuggcuccauuaggccucugccuuuuuuuuuuuuuuuuucuucagcucgaaaacuacuugaaaucuugauugugguauaucuacuuuccaguagaccugauuuguucauacuuuuauaaaucucuguuuuguggcugagcaagguucaccacacauucauuccuagcacagccuuugaacuaauucugccuuaagucauucaacagcuccgaguguuaguguuugccuugcauucuagggccuacuuuaaauuagucccucugauuuucuuggguaaguuacuuagguucugagccuaguuucugcauauauaaaacgagaucauagaaccucgguaaauaugaagcaagauagcuauuauauguuaaagagaguaugcuagaacaguuccaaaggaguuuauaguguaagucauuugugcuugguccugggaaauaaucucuugaaagaggaaagagauuuaugggcaggaggcuuauugugauguucucuucacuagugggcgagaggaggcaggacugggcagaggggagacuuguaggcacaccagagguaggaugcuucuuggugcuuuuaaaccuugagauagguauuuaaaccuauaagucuaagaacauaaaaccuugaaaugucuccccuagaaaauaguaguccuuaggacuuucugcuggagaacuuacguggggaggacucuuguuuugcugaccuuuacuggggucuucuuuagccauaucaguggcaccacagaagccagugugggaugaauaaguuuaucuuauuagcugcuauauagguuuugugagacagacugagagauaaccacuguauaacuguucagaaucaugucaguuuauaauuuuuugaguaccaccugaguacuaucuaugaacaggauuuauauuuugcuuuauuuuugaccaguaaguaaacacuuuauaaccagguuuguaguauaccuuaaauggauugucccuuucagguguuuauuuuauucauacauuuauaaguuaccuacaggaaucagaaguaaaacagugcuugccugauuuuccucccuuuuuuucuuucuuuuugcccaggcuuucuucaguuguuauuuccuugcuucugccucccgagugcuuggguaacaggcauguagcacagcacugggcuggacauugguuucuguagcacagcgcugggcuggacauuggugguuuuuuuuccuuugucaguguaucuuuguauagucaugguuauccuggaacuagcucuguagaucaggcuggccuuuaauucacaaaggucucccugccccugccuccaggaauagugggauuaaagauggaggacaugaccaaagcaaaaaccaggagauaaaucuggcaguuaaucuuguagcuuagucuuaugaguuuacuucaaguguuuaguugugcuaaauuuuaauuugguuaacgaacuugaagguaacugaaggaacguguuaagaggggggaaauauguccugaggauauuggugaucacuucucauacagucugaggagauuuauuuaaaacagugguucccacccuucuuaacacugugacuuuuucauauaguacuucauguugugaugacccccaaauguaguuauuugcauugcuacuucauaacuguaauuuugcuccuguuaggaauuguaaauacccaagauauaagauacaauuugcuaaacacauuaaacucaagagaacgaagaccaaaguguggacacuuugccccuucuuagaauaggaaacaaaacacccauggaaggaguuacagagacaaaauuuggaagugugacgaaaggauggaccaucuagugauugccauauccagagauccaucccaugaucagcuuccaaacgcugacaccauugcauacacuagcaagauuuugcugaaaggacccagauauagcugucucuugugagacuaugccggggccuagcaaacacagaaguggaugcucacagucagcuauuggaugggucacacggcccccaauggaggaacuagagaaagcacccaaggaacuaaagggaacugcaacccuauagguggaacaacaauaugaacuaaccaguaccccggagcucuugacucuagcugcauauguaucaaaagauggccuagucggccaucacugcaaagagaggcccauuggacuugcaaacuuuauaugccccagaacaggggaacgccagggccaaaaagggggaguggguggguaugggggacuuuugguauagcauuggaaauguaaaugagcuaaauaccuaauaaaaauggaaaaaaaaaaggaauuguaaauaucugauacgaaggcugucugauauucaaccucugugaaagggccauucaaccccaggagggucccgaaccacacgcugaaaaccacugaaugggaauguuacauuggcuugcagauguagcucagugguaaagcccuugcgugcccuguguaugggaagcucuggcuucauuucucaguacugggcuagaggaggaggaggagagaaagaaagugaagaguggcuggagagauggcucaguggcucagagcguuuguugcucuugcaaaggaccgggguuuggcucucagcacucacaugguggcucacagcccucuggauuugguucucguacacacauggugauuuauagcagucuguaaguccagcuccagaggaucugacacccuccuguggucucuguggacacuuguagacauagaagugagcaagacacucauacacagaaacuaaaaauacauaaaucuaaagaaaauuuuaagaaagaaaaaaguuaagauaugccaaauucuuuucacauuucuagucaaaaauauauaauccaaccacugagagauaacaaguaauuaauauuuuaauauuuuaagggcuggagagauggcucagccuuuaaaggcuaggcucacaaccaaaauauuuugacauaccuucuuucagccuuaaauuucuuuuuuuuccaaccagaaaguacuugagauauaaaaaaaagcauuguaauuagaagaauuaagaagauuuaauauagaaauuaaguacaugaaaaauacaaaaacaaaagacucagguuuauaaauucaucuuaaaaguagccuguguucagugguaauccucaccgcaagauuugaucauaguuugagacuuuuuaaauuuacauuuuauuuuaugauauguuuuguuuccauguaugcuguguaccacuuacaugccuggugucugcagaagucaaaagaagucauuggcuccccagaaacuggaauuauggauaguugugagcugccacgugggugcugggaaucaaauacugguccugugaaagagcagcugauguuaacugcugacccauguugccagcaccacaauucuuuuucuuuuaauuuauuugugaagaaaaauauguuugugauuagaugaaauguuuauucauaaaaaaaaucuauuacagaauuaagaacuauuaacggauaauugauaaaggucauuaacuauauauacaacacuauuggucagcuagucuuauucuguuuccuucuuuaguuuucccaagggaaauauuaaaucauaccuuuagcagaguagucaaguagaagucagugguagaaguuguauaguuggccuugagugaggaagcacugguccuuugucuuaccauuuauuguauugagauuauacuguaauuccaucauuuccuuuccuugcuccaaucuuccuguacacccuucugugcucucuuucaauuucauggccucuuuaauuguugcagguauacauguacaggcauacauacauguuccuaaauguaacuuguucagucaauauaaugucacuguauguuuuuaggacucacuguuggaauugaauaacuaguugguaugcucuucccuacgaaagauuauuuuucccaauuuuagcauuccuuaguucuucaugucggguugaggccuuguccuccugacccucuuccccacacacguuggcauaucucuuguccuuguucugcucauguugaugagacuguauggauguaguuucugacauuacuaggauuuacaaucuuacuuucugauccucuggcucuuaaagucuuaauacucccucuucugcaaggaucccucagccuuaggaaugggauuuguuuucuugaccuauccauugugacuggacuccacaaccagaauuugauugguuauggucuucuguaaugguuuccaucuauuguaaagagaaauuucccugaugaagaguuaacacuacacuuuaccugugguuauaaggacaaauacuuagaaugugauuagagaucaugcuguuuaaauaaagugaugguuguuggcuuuauccaagauugauuaacucacuaguccugaguagcuggcuagguuccuaguaccaaccauggucucacucuuguugaacaagucuuaaguccaguuagagagcuguugguuacuaccaagggaggagugccacuacugcacucuuagguuaucgugcugcaaugguuguugaggugguucagagguguuauaccuggguagggcuguugguugcuucauuccuuuggaagcuuacauggugacuccugguccuauggaagcuguccucaggggaggaggcagucaggucaguuccagcucaggagcccugggccugugucugacgugcauggaguccugagcaugaggaacuuaccgucugcuucuaggaguggccaaugccggcagcaagaguuugucauguuuggggggucucuuggauacuuccugaccagcuagucaaaagaagaagguguuggggguuuguuagguaaugucuggaucuugaagggaguauugucugcucaaagggcuuauguguauuauuucuuuuuuuauuuagucuuauuauuauuauuuuacuuauucacuuuacaucucguucacugcccccucccaaucaccccuucucacaauccuucccccaucuucccuucccgguuccucuaaguggguggggccccccuggauauccucugacccuagcauuucaagucucugugaagcuaggcgcuuccucucccacugaggccagacaaggcagcccgacuaguagaacauagccugcauacaagggaacagcuuuugggauagcccuuguuccaguuguucaggacccacaugaaggucaagcuucacuucugcuacauaugaaugggucucugguuggugguucauucugcaagccccaagaguccagguuaguugaaucuguuggucuucuuguggaguuucuauccccuuuggacccauaauccuuccuccuguucuuccuuaaaaguccccaagcucuaucuucuguuuggcugugggugucuguaucucucugagucugcugcuguguggagccucuuagaggacugcaagcauaacagaguaucauugaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaagggcaaucggcagauucaucuggaauaacaaaaaaccuaggauagcaaaaacucuucucaaggauaaaagaaacucugguggaaucaccaugccggaccuaaagcuguacuacagagcaauugugauaaaaacugcaugguacugguauagagacagacaaguagaccaauggaacagaauugaagacccagagaugaacccacacaccuauggucacuugaucuuugacaagggagcuaaaaccauccaguggaaaaaagacagcauuuucaacaaauggugcuggcacaacuggugguuaucauguagaaaaaugcgaauugauccauuccuaucuccuuguacuaaggucaaaucuaaguggauuaaggaacuccacauaaaaccagagacacugaaacuuauagaggagaaaguaggggaaaagccuugaagauauggguacaggggaaaaauuccugaauagaacagcaauggcuugugcuguaagaucgagaaucgauaaauggaaccucauaaaauugcaaagcuucugcaaggcaaaagacacugucaauaagacaaaaaggccaccaacagauugggaaaggauuaccuaucccaaaucggauaggggacuaauauccaauauauauaaagaacucaagaagguggacuucagaaaaucaaauaaccccauuaaaaaauggggcucagagcugaacaaagaauucucaccugaggaauaccaaauggcugaaaagcaccugaaaaaauguucaacauccuuaaucaucagggaaaugcaaaucaaaacaacccugagauuccacuucacuccagucagaauggcuaagaugaaaaauucaggugacagcagaugcuggcgaggauguggagaaagaggaacacuccuccauuguuggugggauugcaagcuuguacaaccacucuggaaaucaguuuggcgguuccucagaaaauuggacauaguacuaccggaggaucccgcaauaccucuccugggcauauauccagaagaugucccaaccgguaagaaggacacaugcuccaguauguucauagcagccuuauuuauaauagccagaugcuggaaagaacccagaugccccucaacagaggaauggauacagaaaaugugguacauuuacacaauggaauacuacucagcuauuaaaaaaaugaauuuaugaaauuccuaggcaaauggauggaccuggagggcaucauccugagugagguaacccaaacacaaaggaacucgcacaauauguacucauugauaaguggauauuagcccagaaacuuaggauacccaagauauaagauacaauuugcuaaacacaugaaauucaagaacgaagaccaaaguguggacacuuugcccauucuuagaaaugggaacaaaacacccauugaaggaguuacagagacaaaauuuggagcugugacaaaaggauggaccaucuagugauugccauaugcagggauccaucccauaaucagcucccaaacgcugacaccauugcauacacuagcaagauuuugcugaaaggacccagauauagcugucucuugugagacuaugccggggccuagcaaacacagaagucagcuauuggaugggucacacggcccccaauguaggggcuauagaaauuacucaaggagcuaaagggaacugcaacccuauagguggaacaacauuaugaacuaaccaauaccccggagcucuugacucuagcugcauauguaucaaacgauggccuagucggccaucacugcaaagagaggcccauuggacuugcaaacuguauaugccccaguacaggggaaccccagggccaaaacgggggaguggguggguaguggauuggguggguggguauggcggacuuuugggauagcauugaaaauguaaacaaggaaaauaccuaauaaaaauaaaauuaaauuaaaaaaaaaauaguguuagggacuggugcucgcccaugggaugggucucaaguugggcugguuaugguuggccuuucccucagucucccuccucugugccugcauuacuuguagacaggauaaaaaaauguucaacccaaaauuuauccugcauuauaguuucuuuugguagguaguuaauaauaugauuccuuaagaguuuuucagacauucuuaaugguauuuuaccaucuuccuucuauauuuaucuccuuccucuguuccuagagucccucuuucucuuuccuaucccuuacccuaucagaucacuguacccugcuauucuccucucuauuguucucccacuacccuacccaauggucccuuuuuacuucucugaauucuguacuuacaccagaauauauauucaaccugaagauuuggaguuaggagccucugaugaaacaaaacaugugauguuuguuuucuucggucuggguuaccucauucaauauaaucuuuacuaguuccauuuguuuaccuagagaguucgugauuugguuuuucuuuacagcugaauaauauuccauaguuuauauauacaccacauuuucauuauugauucauugauugaaggacagugaauucauaucuagaguggucuuacuacuucgauuaacucagucuggaaauuuacagaguuuugugucuuaggugauuuuggacucuauugcucaguauaaaagguuuaucguggaggaugaugggaagaucugaccauguuugcugauagagggaaaggaaccaauggaaggggaaagaugaaagauggauucaaaggaggguauaugcaauacuuauaacaaagcugcacacucacaaaggcaggaaacacaagcauucagcaggaaagcugggccuugaaaggaagaagggguccuccuaagaaaaguaacaaggaaguuuagugguggcgcacgccuuuaaucccagcacuugggaggcagaggcaggcagauuucugaguucgaggccagccuggucuacagagugaguuccagaacagccagggcuacacagagaaaccugccucgaaaagccaaaaaaaaaaaaaaaaaguaucugauguagacaaaaguacauacacauaagaaguaaauaccacauagucacauuuuauaaccugcguuuauacuuaguauuuuauggacauuuuuaauagcuaacuaaguguauagguauuaucauuuuuaaagaauauguaguguaccauuaucuuucugugccuuagagaguauacuucuucuaugugacucguauccacacauacauaauuuaucuaguuacuucuaccuaagucaauuccuguugcuauauaucuguaaaugagguuauauugaaaccacugaacuagaccauuuguggguaggggaaaaaaagguuuauugggcuaucucaggacauggguugggggaaaaauggcacaacagcaaguagauuuuauaugacaguuaagaggaugagucuuugagcugauaaaacuguugcacuugacaagacuaaugcucuugcucaagguucaccugaggggugucgaggggcagauuaagggagguucuuggaaaacagaaacccaccuauaggcuucuguugccugccaagguucuuuucauuaagacauugucaucaacaucagacuuccaugggaguaggcaggcuuuggaccuaacagucaaaguaacgcaggcuuugacauuuuuaaauccuagaaauaaaauuuuacaguucugaaaguugggaaguaaaagaucagguaauagacuuaguaucugggcagggucugcucuauggauuauguuauuuuaucacagcauccuuaaagagcagagcagauagaaaggaugcaccuagucgaagucacuuuucuaaggauaguaaucccaucucuauggccaccuucugagcacuagcugccuucuuaaugcuugugcauugggaaucaaauuucaacaaaaguuuuaggcgagaccucgguuuuuagaguguauguuacguauggacuugguauguaaagauaaucaaucauuccaccuaguguggugcucaccuuuaauuccagcacucagaaagcagaggcaggcagaucucuguguuuaaggccagggcuauauagugagagccuauuuuuuuuuuaaaagguaagucuauauuuucaauaaguuauauuuuugugccaucaaaaaguugugucguuuuuccaugaccuuucuagucucuaguucuuaguuuuacaagcaugcuagagaguuugugggacccauaaaggucucagcaaugggcgagugcuguuuugacucggugcuuagagcagaugcuauuaugcuuagggagguuagugauuugguagcucacagagauucaagaaauuauguacuaagggcagaugacagauuaguggcuggugauaaugaaggugcaagcauagcuguugacauucugugugcacuauucuaauguuaguguugaagaugacugguauuauauggguuuuuauuuaagcaaugcuuuaacuauaaucuuuucuucuaccaucauuucucuccaguuuaacuggaaacaaaugggaugauuuagaaaaaaaauaaauacaacaaaguaugaaacaguuaugccuuccuuauaaagaacuaaacacaaggauuuuauugcauguacuacagcagcagcggugaaauaagagcugggccguguguaguaaagaauugcuuuaacuguaggggcuggagguaaagacugagaggugaaaggaucaugugaguugaagauugaucaacagcaagaguucauuccauuaguguguucauuguuuuguuuugugcacauaucuauuuacuagacauuuauuaugugcuuauugucuucuaaggcaggaaguauaaucuuacauuauacacaggagcaccagaaucuacacuuuuaaagauguuccaaguaggaggaaguaagaaaggcccugaguuuugguugcugucaacgugaugugacugauggggcugaguagucaguuugguugugugguagccagugaacuaccaaucaucuagcaaagauuguaaccaggacagcugcaggagccauggguuauugaaacgcuugccaaguaauuguauauuuuaacaagauuaugauuauucuagagcuuuuaaaaacugguaaaaaguaagugguuuuaauaauauuuguaaauuauguuguaauuuaucagauguggaaaggggaagcaaauaacuuauacuguuauacuuaggacuauaaaauacuugaacaaucugagaaaaauauauuaagagggagcuuuaagaaagaugacuuaaugagaaacugaaauguuaguuaucuaaacaguuagcuuagacugcauuugcuaaguuacaauggcucucagaugcacucaguacagugcaggucauggugaaagguguuaggaaggcaaagcauucccucuuccuucauagagucaggccucgaggagcugcagguuagauuguaacagaaauaugugcaacaaagucauggauagaauuugaagcuuucuucaauuuaaugguaaggaauaaguggggaaaggacacuucuggagaaagucaacuuuguggaaugacaaauggacucuuaggauaaauggaagaguccaaagauuugugauggugucuccuuugugugguggagagacuucucaauucugguaguaaggagcagucucagucaggugaguuuuggaaacugaguucuuuuggugggaagagggaggcuguucuacuuuuaggcagauaagagauuucaaaaagcgaaagcuguuaacaaauacuuuuguaaagaauuuuuuuaaccauaaugacauauucuggacucuuaaaguauuuuggugcucaaauuguaucacccuccaagagcaacuuaagauaguaaaagauaacccacaugccauaauucagaauuucugcuuauuucauuucauugacaauucacuugguauagaaugcuuuaagguauaagccuguauaaaacuaaucaagaggauacauuguagcaaaaguuucgauuacuauuguaaguuaggaagaucacacuuuaauguauauuuuccccuauggguaaacauagguuugguuauauuuuagaucaucuccuuucaagcuauaaaaauaugucaggagagucuuucugguguugggugaaaucacaagcucugcuugacauuacuuugugagcgugaagaugauuccaacaugauauuucauagaauucuauuaaaaaacuuacuacuacuuguuaugacuagcagagugucuggucagaaguggaaacugggcaauauacagaauuaaguucuagcuguuuuuuauuggcagcagaugaagccuguaaucugagagacugagccugggauaguuggcagcaguuguuaaugaacaaauauggugugucuagagcagugauagauuccagaagucacagagagagcuuggcauugagaacucaaagugcccuucagugguugaagaagaaaugugcauaucuagcacguggggcagcucaaagacuucuuccaaaggguuuuuagcuccgugugucuucuuccucucugaugcuuaugcucagguagcaguaagggcgcaguaaggggagcugcuggucaggagugccuuuccuuuucuccccuuccuccucucuuuucucuccccccuucuuggggauugaaccuaauaccuucucauuacuugcaagaaaaacauacuauuacuaagcuauacacuauccuguggaauaguuauuucaucauauugucuaauguaaauuuuuaacaucauuucuaucuuugcagccacauaaaugaaaaauacacaaaucauuugcauuugaaagauugucagugaguaaacauuaucuguaucuuggucauuuuuauuuuuuuuuccuguuaaauuuuuaaucuuuuauuuacaaguuuuuguguuuuauugauuuacacagucuuuguauauucaggguuuuuugcaucuguguauuacauuuuacuauuuauuagucuuucagcuuuuuuaggucagucuauacuaccuggaaaugucuuguaugauuauauacuaucuacauagauacagagucucuggaaaagcugaagguuuggaaguuugugcauagcaucguuauugacacuuaaguccuuugaauacaguugcacaguaaugcuguuaaguuuauggaaucuacugauuugacugcaguuucugcugcccuccucggugauucucuuuaucccuggccacuacagucuagcagacagcugagcucagugcucaacaccugacucagauucuuugcaguuuuuaugccauccaaguggcauguugcagcugguugauaaaggcuccuguuuccucuucucaugaaccagguugcaaaaugagaccucuuaaaauccaaauggccuauguuugguuaugauaaccaacuuaaguucagagucagaagaaagguuucauuuuccucauucaggcacuuaaacugaaguggcauguguauguuaguaaaauuagaccugugcucauuuaaucacaguuuauucaugcacuguucaugcugcuaauccaggcaggcccacaccuuagauaucagugauuuggaaaaggcucucaaacucacugauuaugcuagugagugagauugagaggggcaggugagaguuguacauuuguguugccauuuugcaagauuccugacucuuuccaagccuaauuuaucauuaaaagcuaugugcauguacaugcuucuaugcaugccucuguguguggguuuucuggugugguugcuguaaugugguccauugugccauaguacacauguggaggucagagagcaacucugaagggcguucuguucuuccaccucugugagaguuccugggaucagacucagguugucaggcuucgcccuaagcccagucuuaucuagagaacgugaggguaacaugauauugcucgugacgagcccucuguaaaccauaaagcuguuugaaaaagcaauuaguugugccaugaucuaggaguuuuagugcuuucuagaugaauuucugcuucucgguuugugaaggagaauggcugcauuccaacuagugaugaaugcaucugaucuguugcaaccagcaauccaggacagaccuuggccuuucuccaaggaguucacagugaaugcuaaucuuccaaaauucauguggugcuuuuguagggggggggggcuuuugugucucuacagauuuggauaugagagcucuuacugugcagauugcccuagagaaccuuccugcuggccucagggaagaugaguuaucugaguuagucuuucuagaauugcugcaaaaggcuuuaugauacaauuuaauuuccaggguuuuuuuuuccauuaguuuauaagugauacuucacuuuuucccuuucaguuuugaaaugaauaauuuugaaucuuggagaauguccauaguacaaaacuuaucuguguuuccaaaagguaaaaaaugaagguuuaguuauuguggcaucccuagcuuaaacagucauugggagucuguaaguuggcacuuacuaguuucccuuagaacauuuuaugaacugcuuuucaaggguuauaucauagcaggcuacguuaagugucuauguaugagguaagguauccuuuuuaggccaagaggauauagucaggacugauuugagguuguuuucauuugcacuaaaguauauauaggacuuaagcaugcccucucagucuagaagccuugccuuguuguaacggauucuuuguugcuugcugguugcuacgagauaguuugagagaugcuguucaguuugacuguaggcaaaggcuugucuuccuaagucccgauagaaugacugcgugggugauaacuaggaagcuuucuuaccagguuauuuugaaggaaacaugugauuagagaguaucuuuuauuuuggagauuucagcucagcaaauuaaauaaguaaauguaauuguuuauuuaaggauauagauagagggaggacauuagcuguauugugauaagauauuauugguuuaaacucaaaucacacauguuaguguguuauuccaccaggauacaccugaaagaggcuaaacuuagucuuagugcccaguguuuuuucugcugucugauuuaauauucuccauaccauauugcguuucuugacuuucuuuucaaggaaaacugcuuuuuuguuuguaacuuucucccuuuccuuuugaucucagcagcugucucagcuccaguagauuugucuccuugucuuuuaugaaagauaagggucaggaagcuuuugugauguaguuggguuuaaauauuucuucaacguggcuuagcuuagaaguuuaguaaguuugagugcuaauuaugagugagugcugaauguuuugaauagacuguucuuacuuauagaacuuuaugugucuuacucuaucugguuauucaaaauuauuggugacuaucucugugcucuuuuuuuuuuuucuuuuccuuuuuucuuuuuugguuuuuagaggcaagguuucucuguguaacagaacccuggcugcucuggacucucuuagaagaccaggcuaaccucgaacucacugagaucugcuugccucugccuugaguaugggcuuaaagguguguagggccauggcgcugccuggcuuuucuuugcucuuuuaaaagugcugcaggggauucaccccaggaccaugagcgugauggacggauguuucaccauuaacccacaucucuagcccagcucuuuacucugugugugcugaugccuggggauggaggaaggaaggccacgaaaaagcuaaaugcccuggaguauaugacuaaaggauccucugugugucugggaagugucuguagacucugcaugaaggguucuucuuauuucuauuauguggaacugugauauuuuuaucagaaagaaucauagaucauuuucucuacucugauagucagacuaaaguagccauauuuugggucuauguccauuuggguuuugacaugagucauaauauagcuuauguuagaaaaugaaaauggggcuuuucuaccuucaggagauuauugaugugucuuuuuuacugauguuagcaugccaagccagaauaagaauuuaaaauggguaaauaucuguauuuaguuugaauuugaagcuagguuaacuuuuagguucuaauugaauuuaaggaaagaauagaucuaggagaauagacuggguagacugagauaacauaaaaguguaugauguuaaauacaagugaagaccugcuuggaaugacagcauuccugugcuuaugaacuuagggcagcugugguugcuugcacaaggucaagucagacaacauucuaacauggaguggaguccuuucaugaggccuuccuuuuaauugggguuaguuugcaaugagaauaauagcaaaauugucaaaaucaaguuuucaaacucugguaguuuauuuaauucuaagaaugccuuuucaacagaaguaguuggaucagaauaaugggguuuguggugauuuagcuugucuuguuucuacccuucuucuuuacguccaugucaaaguagcuuucaaaacuauaguugcuugguaaucauggaaggugggauaggucugaaguuccccuaacaauccuagcccugcugaauugucacuauuuaaucugucuagaagcucucuggaagggcauguccccuugaccugccauuggugcaaaguccugagaugucuguugaaaacaguugccugcaguuacuuacugaagcugcagaagugccaauaguaauuauaauaguuggggccaacaaaaauugguucaugaaacguaaaauaaaaaaucuggggaaugaaguguccuuaugggucuuaaaaucacagauauaauccuguaacucuugaaaaccaugucuuugugcaggguaauaugcauucuuugaaaacccuggaaauaaggcuccaauucuaccuguggcuaaccuccagauuccacaggaccagaaauuaauggcuaaaagagaguuuaaaacuguuacaucaccauuugaaggcacgccccaauguauguauguacauacagccuuucugcaaaggcuauuaggcuuauucagguuacuuaagaaaguccgugcagauacuaaccacuaaguuagaugaaccuuacuuaguaacugcacaggacaaaacaaaaacaaaacaaaaccaaaaaacccagucccccccccaaaaaaaaacccaaacaaacccuuaccaaaauuacuucaagaauauuagcuuaucuguauagcaauaaguaacagugacaagucuuggaagacaaggaaaccaacauguuaguuuuuaaccuaauauuaggcauccagguuuuaauaaaacaaaaauacaaggugagcaaaaaaaggggggcuaugacuuacuuuuauuucccucauguuuaacccacauaacaaacuccacauugggcauauaacaguuauuuaagaugcuuuuugaauuggccuacaucuucagcaguugauaggaauuagagcauuuucagagacuucauguauuuuuuuuuucuucuauaguuugauagucagguuuuucccccuguaacaaguauuuaaacggcucuguuuauaaaaagaaaaggcugcugggugugguagugcaugguuuuaaucuuagcacucggaagacugagacagcuaggccuuugaaagcaagguugguauggucuguauagugaguugcagguccaggcuucagagagagaccuagcucaaacaaagaaggaaaguuuguuuggguagaugauuuucgacguuucaguuaauuggcccuauugcuuuuugacuguggagguacaucgucagcacaugguagaccaacuccacucacauggcugggaaguaauaaagagaggaaacgguugguaucccacggucccugugacuugaaagccuuccaguaggcccccacuucucaaaguucaccacauucugugaaccaagcugaggaucagacccuuaacaaagagagcccccuggauuccagaucaauacagcacacacugcagucuuugacccuaaaaugaaccuggugauuuuauuuuaucuuuuagaagaguccuuuuuaaguguugcuuauccaaaacaaaucccauaccuaucuucauuaguauccauguuacguggcagucaguuuuaauugucauuuugacaaucuacaaucaccugggaaagguaucucauuggaauuaguuuagcuuguggccaugucuugauucauaggaagacuugcuuuuuuugagagacacaaaacaaaacuaaggcagucaguauccuguaaaauagagagacucuuucuguacacaauuauaugugauaaacuugcccagaaaacugagucauaguuuuaugaagugauuaaaguuuauaguuugaguaugaaggcacuuugggaguguacuaugcacauguccuuguauuaguuaaguuucuggauacuuuggccaaauacuugacaacauacagcuuaccuuuuuaauucgguucccagggcagaggguuuuaauucucaugguggggaagucauggcagugaauguggcuugauuuauagugcugaccaaaagcagagaaaggggaauaucauuguuuaucuggcuggaccaagaccaugagaauggugucccuuacauuuagaguggauugucuuucucuaauaagccucuauguaaacacugucaaagaccugccugaaggccugcuuuagugccagggguauucauuaauccaaucaaguuguucucacaguucuuaucuguagugacuucuacugccagguacucaaguuauucuauauuuuacuuuucuuuuuucauuuuccuuuucuuguuuuuuccucuccccucuccccuuuccuuucccuaucuuuuuauuuauuauuuuguaggaacccagggcauggcacaccaggguucucucuaccacugaacucuacuucugccugcuuuguggggagagggauaguaucucaguguguagcacuggguggcuuugaacucaacaauccuugauccuccugccauagcuuccuaagugcugggauuauuacugugugccgcuaggcuugguucccucuuuauuguaguuaggcuuuuuuuuguugguuuguuuugcuuguuuuuagucugauacaguaaguugauguugacuauacuuacuagcauauacuaauuaaaaagaaaucugaccucauccguaauauuuguaaguaauuaaauauagcugugauuaguuacgaugggcaagauucagguugucauuuaaugguguuccauucacuguagaaguagaaaagaggaaguggaaaguguggauaauagcauauuagcacacaaacuuaucaguauuuccaauagucauuugcuuuuauuuuuuugucuuccauauuacucuuuuguuuuaauacaaaaaagaaaaaucuacuagacuggcggucuagucauguguuacugcaaaggaaggauuucugcucacugaauuugcauugaggccaaccaagcuacacccuucucuggcuggcuuugcaaaaugagggcuggaacuuuggcaccuaucaaguacagacuuuaauucauauuugauaaaacugaauuguaaguuaaggaagcaugugaagagacuuuugcuuuaguuaugaacuuccuuuacacaauuaagcugucuuucaaaagaauauacauaguauaauguaaauaaucacagagaauauuaaaaauagggacuuaauaggugcaauaguguuuaccccaagccauuagaagaaguaggucacaaguuuagcuuuaguucuagcacaaggucaggaggcaaacaguagugaugugcucuagucuuuauuagguuaaauaacuaaagccagccacuuaacugucagggauguaaacaacaaaaaaauguuaaggacaauauuuuuuaauaaauaagcaauauuuauuuugccugcuguuauuaugaaaggcaauuuguccaagggaugaaacaguguggcucaguaaccaucucuuagccauuugacuugagaagucuauuuuauuuugcauaggaguccuccaccuuauuguccccaguguccacaucugauaacaaaacccaggacugauuuaagaugucauacuauagggcggauugccuguuggggaaguuugagggcucauuauacauauaucuaugauaacuuacugaagaaaacuuacuuaaaucacucugaaguauuuccuaugugaaguuuacaguuugaauuuuaaaguacugugcuggcuaggguuuuuuuuuuuuuuuuuuuuuuucaacuuugcacaaaguacgagucauuugagaagagggaaccgcaauugagaaaaugacuucaacagauuggcuuguaggcaagccugugggacuuuuuuuuuuuuuuuuugguuagugaugauguaggaaggucuggaucauuguagauggugcucucucugggcaggugguccuagguuguacaagaaagcaagcugcacgagcauugagugagcaagccuguaagcaguauucaucuaugaccucugcugcaguuguugccuacagguuccugcauuaagcucuuuuccugacuuccucacgggugaaguauaaacuguaaauuguaagcugaaaaaaccuuuuccuucccaaauuccuuuugguuuuggugguuuuuaauuacagcaauagaaacccuaacuaagacaagcauuuggggaauauauuaugcuuuguccucauauguccuuauuuuagcuucuaugcuuaccuauggauuaugacuuaaaauugcuucuuaguugagcuuuuagaagauacugaauaguagcaaauauugguuauauuuucugacaggaagcuggcauguacugcucacacugccagauaagucaguauuuuaucuauuggacagccagggagagguaaaaccuuugcaucuucagccauugggauuccaaagguggggaggacagggacucuccugugcucuuucuccuuagacaccacuuggcaacucagaggagagaaguaguacauuuugagguccugaacuauaacuuucauggcaagugggaaucuauauaagaaaauaaagacauuuaauuuuggccaaaucuugacuacuuguuacugaauacaaaggauauuggcaaagauuaugaaaacccagccuguuuucucaugaacaaacaggcuuuaaaaucugaguacagugcuauaaaaugauguaaagacuuuaaaagcuguccaaaaagcucccugcagauauccacgucuacaugcaugcacuugcacauauaacuuuuuaugaugugaugcaacuuagaaaacuggcccugcuuuuccuucagaaagaugcuaguacugcaucugggugcuauaguaccacauaguuuucuaauauucuuaagcuguaaagcugagcaagagaaaagccuacaaauuuauugucuaggacaguaugauccuacuauauaaaucuaauuguacaaacuucagauagaauaauauuaacaaaagacuuacauuauaugcauaacuuuagcagauauaguucuccaaauuaugcauuaaaccacuuuuuauuucuaaacuagcagaugauuaaauuauaaaaaugcuuuguuacucagugguccuauuuagagcuacuaaccuuaggcaguauauuuccaugaauccuuaaccuuaauagaacaucuucaaggaucugggugauuuggugauauuuugauguugucuguuauaauuuauacccuucaaaguauuugggugaauugauguuaguguuuaaaaacauugugaaaaaucagcaacuuuggaggagaaaugagauggggugaaagauacugacacaucccauuguuaauuuaugagauaaacuagauguagaaauaaagcuaauacaaguuaaaagacacccauuaaauuaaaacacaacacacaaugauugcuuauuuaggcauuuugaacauguuuuucuuauacauaaaucacagacucaagaugauugauuuguuuguuuuguuuggguuuuuuuguuuguuuuguuuuguuuuuugguuggggcaggucuuuaggaccaguuucauaaauaaaauuauauuuugugcuuuaugaaucccugucacccaagcucgggauaaagggcuuagguuggagaagauauaaaguacuuauuuuuugauauugaggacaucuuuaagauguuaaaacaagucaguuagugaaguguuuggaguaugcuagccugcuuuguuuauuauaggggaaaauacaccucuaccucuuuguagcuuaaaacacacaugagaagucauggucaacaagaagugaggucgagaguaguacaggcaagauagugguggcguuuugcaugagagcauuuauuuagcgugguacuuggagggucacuguagagagaugugugaguuggagucaggagucuauggccuaggagucugugauagggaugugaggcugagaggaagcugagaggaaccaggugggaaagaggagggggugugcuugugugcaguggaaggggagaaguaaaaaaggguuaauggacacugugccauccuccccgugugucucagcagucugcguaugugacagaagauugguuaccucccuggagcugugcuauaaacucaaauuucuugauauuuuuauuuuuuaauguuuuuagcauuguguuguugcagacugacaggaguuuuuagcaauaauugcuuaaaguuaaaugaauagguguuaagcucuauuugaacuacuucaguaauuuuuauuacucauagugacccuuugauguaggcacuguuauuucuaccauuuuauggguaaagaaaaaaaaacaguggcacgggaggggggggcaguuaaauguccuggccaaggccugaaagcgaaggaauugagugcuacacaggcugacuuccaugucugaagcuagaagugaagacgcucagcaggaguacaugcugugaaagagacuacuuagacguggguugcucagaaaugcugaaauucaucuugguauucugaggaaagaagcuugggcguguaguuguuugagaaagugagguaacaauaaaaggcuggguauaucugucccuccuuccuaucucuguucaccagcacuucagcuacuccagaguagcuugguccauuccuuccauaccuacugcauuuccuagucacagacuuacaagguuagguaacucugcuacaggcuucagaguuuagaaagucuuuauaaagucagaugaucuaucuuccugacccagccccccccuaacucucaucaugcguaggauacuugaaauuguuuuaaaggggguggagauaacucaguuuuacaguuaaauuucugaaaacagaguaccucauaggugaacagugaugacuagucuuuauuguuuuaaauuuaaaguuuuaguuuuugagaauucauacaugaauacuguaucacuucuacccgugccuccucccucccuccaacuccuucuauguggccccuacucccucucaaguucaugacuaccucuuuaauuauuguuacauauauguuuauguauauauacauauauacacaacugcugaguccauuagaguuucucuuguguauauguauuuacggcuuaguuuaaaucuaucaggcuuaugccuaaagaagacuaaaacucuccuagcagccauugauugccuauaguccuucauucaaagguggggccgugugagauuuucuuagccaauauuggcauguuagcuaguauuuucuuuagauagguuuuguuuuaauggccauauuguugagauuucauggguacagccucccuuucaagaauagaagacacuaucuugaagcacauauccugguccguugggucuucugcccuauucuucauggugcuccaugguauuguagauguauuaauuugggaugaacagccaguucuucucugcaaugucagguuaccagacccuuuaaaaaguuguuaggccugaaguggaacccaguauauaguauggagagagaugacaaauugccaaguaaccuuagcucuguuacuguguuguagagacuugaaacuucugaguuuuauccagaaugagcaagauugcauaagaaaaaaaaguguauauuuuuuccuugaguacggggaaauagaaguuggguccuaaauacuugaggauaaaccugugaaaacugguccuggaagguuuauauacacgauuuugguauauauauauaucuggagggcaggauaugagugguauguggaguauuugugugguacauuuaugaacaugcuuguauguaugucccaggguucaugugagagccagaaguugaccuugauagccucuaccagucuccacuuuaucuuaaaaaaauaaaacaacaaaaccaaaacaaaccaaaaaguguuccacuaaagguggggcugauugauuggccagccggcaagcucuagcaaacugcauaucucccugccugcuccaguacugggcuuacagaugagaugaggacaccacaccuggcuuuuaugaaagucaugcaugugugggugacaggaagcaccuuaccagcugagcuguuuccucagcucucuagacauuuuuuuaaacauugcugacuguguacaggccguuugcagugucgcuugugagauuaucaugauuuaaugucucaggagacgguugugaugcaugcuuuuacugaacggagaguuucucuuacuaaaggguuuuagaugugucugguuaguucaucuuauuucuaucucucugggacugcuguucucuuaaggauuagggauuuuagguggugcuuuuaaucucagcaucugcaaaggcaggcugaucucuugaauuugaggccugcuuuggucuguguagcaaauucaagacagcuuaggcuacauagugagauagcaacacaacaaaagaguuagggauuuuauaauauaacuaauuuaucguagauaugauuuggaaucuguuggugcuguuuucuuagagucacaaaaucugauucuagaaguuuugguuaggaaaugaagagugaagcaucacucacuuaauuucuaagcacuuguauaguauauccaaaacagaaaagugggaaacagaauggggcaguuugcauuuaguuggggagcuagccacaagguaggauguuauggugggaguaguugaaagcaauacacaauauaauggaacuuugcaguuuauaaaggcuacauccaucugagaugaguagcagguaggugcuuuugucuugaugggugaugaguggcucagugugggucagcagcagaauuagcacaugcacuccaucuuucuuacucaucucugcugccuguccuguguggucaggggaaggagagagugcaugagaggauagggcagaaacacaagucccugugcuguccccacugugcucuuccuguuauuauuucuaaucauccuauugcuuaaucuccugccuuccucccauccucacucugggguuggaggugugucagagugugaugucuguugcguguauuacucaauguuaagcaggcucuugacuuuguauuguuuuuguauccuagcuacaaagccacauuacagaggcugauguguaaacauacagagcuggcaagguggagugcuggccgauauuugucagccuuucauugcuauaaugaaauaccugaggcaggguauuuaugaagagguuauuuaacucauagguuuggagguuccagggcguggugugugcauugguccaguucugugugggcucuguauggcucuaguaagggaacaggugcccagucagccagguuacuaggacugcauuucagaaguauuccuaacuaacugcagacaaaaaucaagaaauagagcaacucagugaucauccucuugcuccaagagacugaguguccuuccaagggcacaguucuuguuaggcugcaccccguaaagguccauauccucucauauugcuacaguggggaucaacacaugcauauaugggaauacucaacuauguccacauuguagcagggccuuuccacauagaaauguggaugcagaaagcaggugagacuugcuaugaugagugaugguggguguuuaaagccacagggagguguggguagaguuaugaaguuaugucuuucuuccauguaucuguauuagagcucuuaaaaaagauuuauuuauuuaauguguaugaguauacugucgcugucuucagacacaccagaagagagcaucaaaucucauuacagaugacugugagucaccaugugguugcugggaauugaacucaggaccuuuggaagagcagccaguugucuuaaccacugagccaucucuccagcccuaaagcucuuaauucaguuugcugcuuaaggguccagcuuccagggucuguuagauaggaguugcuuaauguucagauuuaaguguaucugcugcucuuuggaaagaaucuaaauagaauuuuuccuuauuaguuuaccuuagucuuuuuuuuuuuuuuuuaaggcaaauggacuucaggauuuacauuaugaauaauugugagugaagagaucaguagccacccuguuaauccuggguucauauaucuuaguuauuauuauuacuacauuuccaagauaugcuauuuaaggcugucccucugaagaauugaagguuaaagcaacugaacuuuauuugacaacauuuucaaggacauaguccaagugguuguaguuacucaguaugaaucacuuguacaguuuuuuucagugugcuuugguauaauuggauuuuuguuccucuaguauuacagcucguucuuccuucugcuuuugucagguaugaguuuuacauggcagugucuuaaugaaacuuuauuuugcuccugauuguaagaggccugggucaggugguauaguagguguguaaagguaguauuugaagcaguaggcaggaagaccuaauguuuaauagaugucauauccuuucuguucuaagcacuguguguguauguaugaauuuuuuaucauuaacaacuaaaguauuuuuaucugcauuuuccacagaagaaacugauaagaaguaacuuguccaaggguacuagcuuguuuguaaaucuaugggucacaacacccuugaacaacccuuucacuuaagaccaucaggaaauacauauuuaaauuacaauucauaacaguagcaaaacuacaauuaugaaguagcuaugaaacuaauuuuaugguugggguccccacuucaugaaguacugaauuaaaggguugcagcauuaggaagauugaacacuguaaaugguacugguauacaggcauccugauggcagaaucaaugcucucgauuacucgccuauacaaaaugggauuuguacaaaugaggauuaagggcuuagacuccuuggaggcagauggaggcccacagcagucaucuagggcugcucugcugagacccuggcacccugcucugaaggagacaacuggaguucaggaggcacagcuaggauuugcacaggcuuaaagguaugcccacccaugcuguuggaaguggugggaaguuguguuaguuauucauugggcaguggucagguuguguuucuaaggaaguuggggauuuguucccuguguuauguuuucaagcugcugaguuguccuaagcuucuaaaacaugcucugaucucagcauuggcuguccccuguuccauucacauucuccuuucuucccuuuguggcuacacuccaagucucucagggaguuacagacacauaguugccaccuuuucaucuugcacacccuuugcucacuauugccuuuggugccucccucccucaccagaagaacaacccucacagagauggcagugcuugacucccugcucauucugugagcuuuugacccuuaccuuacuaguaguuuucagucauuuugcccuacaaggaguaucugaaaaugucugcagacauuccgggcauuaaauuugagagaaaggauacuauugguaaccauuggguggagggcaaaaauguagcuaaauauuuuguaaagcacaggaucgcuccugccugaggacuuaacuggaguucuguguaggcuaacagucuaaccagacauccugcauuuaguaucuggugacucuagaagaagaguugagaugaggcuggucuauuuucucagugcuauccacuauucgggacagaugcuaucuaaaaccccuggugauaaagcacuuugagggcccuuuugaagaugccaccagaacugguugggguagacgcuucauauuccuaguugccuugcaguuuuaaaggaacucugauacugucuguuguuauacccacaucuugagaaaacuuuauaccacacuguuagaaggccagacacacaauugaacuaggaaggauuuggacuucuugaaacguaccaguaugguuuuuuguuuuuuuuuuuuuuuuuagcaaauaauaauagaauauaaauuucuuugggacagcaucguaucagaagaaaauaauggguguuucuaaaucugccugguguuuguucuaggggagguguaacucgcacgaaugggccaggcggacagauggacgcccucuggaguccuuguguccuugugcugaaucucguuuucuuccucuuucaggagcuccuugugccacgccucugaucugcagcuuugggagaccaguggaccuggagaaggaugacuaucagaagguggugugcaacaaugagcacugucccugcagcaccuggaugcaucuucagugcuucuacgagugggagagcagcaucuugguacaguucaacugcaucggcagggcccgcagcuggaaugagaagcagugccgccaaaacauguggaccaagaagggcuaugaccuggcuuuccgcuucuguuccugccgcugugggcagggccacuuaaaaaaggacacagacugguaccagguaaagcgaaugcaagaugaaaagaagaagaagucugggucagagaagaacacagcaaggccuccaggggaggcuggggaggaggcaaaaaaaggcagggcccugaacaagccccagaagggccugaaccaugaccuuccucggcggcacuccauggacaggcagaacucccaggaaaagacagucgguucugcagccuauggcgcccgcuccccuuguggcuccccuggccaguccccacccacaggcuacucuauccucuccccagcccacuuuagugguccccgauccuccagauaccuuggggaauucuuaaagaaugccauucaucuugagccucacaaaaaggccgugccaggaggccacguguucagaaaugcccacuuugauuacaguucggcuggucugucuguacacagggcaggacacuuugacaccccuguccaguuccugcggcggcuggaccucucugaacuucucacucacauccccaggcauaagcuaaacacuuuccauguucggauggaagacgaugcccaaguaggccaaggcgaagaucugcggaaguucauucuugcagcccucagugccagccacagaaacgucguaaacugugcuuugugccaccgggcgcuccccguguuugaacaguucccucugguggauggaacucuguucuuaagccccucaagacacgaugagauugaauaugauguuccuugucaccuucaagguauagguguuaauucaccuugccugguuucuauuuguuaaaacccaaaaaagcaaacaagauggaacuacauuuuuacuuuauuuaauuguaacugacauguuuuuauucuagccagggacuaaauagguaacaugaguauuccagcuucucccaguggcuggugguuuuuguacuuggaucucacuguacuggguacaauuuuaugucuuuguuuugugcuacuuugaugaaaggauagcuaauguuuagcuuuuuauaacuggguaaaaauuuauagaagaaauuacauuuuucucuuugcugugaaguaguuugaaaccuuuaaugugcccagcaggcuguuauccuuguaaacagggaaaggaggaaacaagaagggccaguguuagucgaauuaauuuuaaaauugugaaagaugagaacauugauaguaucaaaaggaaaaugggggaugauugaagcccaggcaugccauuaguuggggaacuguaguggucagcuuauauguaugacaaagacuuggguacuuuuuagccauaacuuaaauagcaaguaguugggcaguagaggugugaaauuaaaacuguugaacuuccaaagaagagauacauguauauaauaguucauaacuuuaacaauaugcuacagugucagauaaaaaugauuccugucuucuucccacuaaacccugcgguuuccacccccagagccaaacacauugaaaugcuaagugauucuucaagguuuuugacaucaggauuuugaauacaguucucuuaagucucugguuuuaaguacuauaucuuuugauaagacuggcacauaagauggaugacuacggaucucuuuccuuuggagauaaaucccuaguguuucuacucuauguuaaugguguugaacauuauauauauauauauauaugugugugugugugugugugugugugugugugugugcgugcgcguguauguauguauauauauauacauacauauauauacauauauauauauguauguauacacguguguauacguguauacacgugcacacacacacauauauuuuucuucauuauaucccuugaaagggauacuuuuaaaaauuagaguucauuucuuccauuaccauguguuuguuguuuugguuuuuggaggcaaaggucucacucuguaacccaggcuuggugcagucacagaccugggaagacuuauuauugagaacuaaccguugguuuagcgucuuaagguucaagugccugagagugguguauuuauuuuuuguuuuaacuuugggcaguugcucucaucuagcagcuuuguaaaccacuuuucuaaagcauuucuacacacuuaacauuuuuugaaguuucuuuucuucuguaaacaucucuucugaaggcuuucauuucuaugcucucucuauucuguccugaagaacucaggaccugcuggacuugaaggaaagccuuucuuauuucucaugcuuuaugucuugccuucuaacccauauuuucuuuucuuuacuuuuucccucagacacccucagaagcugcgacauuggaaguuugagaaugccuucauucauuccuaaacacuugguuguuaccuagccgggucaugcaguccuuuaaauuacaaacauuuauuuuuggaaacuuagaaaguguuucuuuacuaucuccugucuuaccucguuacugucuugaagucugaacccccaacccccaaucucuguccucuuuaaagaaguugacuucucccuuacucucucuccuguuaggaaauccuacuauauauugugguuucucagcuccucugccuucacagacugugggcugucuuggauuauugauugaguacagaaacuuagauccucacuuuggagaaacuuugcuuuuguauuauaaauacaaaacuuugauaaauuucucucuuuccacuuaaugugugauauuguaccucuuagcuugacauuucugacuuucuuuugacgggaaagaaaauccuguguuuuucuguuauguguuacucuguuaaaccuucuggaaauggaauguuucuuuagauuucucuucuaguauuuugaauuucuaggaucuuuugugugcuugcuuuuuugagacacucacuauguagaucaggcuggccuagaagagauauuccuggcucugccccccaaaugcugggguuaaaagcaugugccgccaaaaaaccaagaaacauucuuguuucucagaugcaauuucuuuucuuaucuuucagaguaagagaaagguugcaguuacaggguagucuucuguggauguucugugugguucucaggaauucuuuaguuuuuguuguaaagugaaacuccccaaagcccaguggccucaagggacuuaagcccucucaugguuucauggcuggguugguuaggacgguuucucauccaaccggugauagacagguuggcuucuggaacucccauggaauggguucucuguuagccaugcccaccuuuauccuccauuagguuaauuugagguuuuuuuuuuuaaguugugcuucuaauugaacggauuguaguguaauguuuuugugccuguuuauauuauguaauaagauuaggguacugaagauuccauucacuucauauuuauaaucuaugugauaagaauguuccaaauccuacuaauuuugaaaaauauauaaugaacuguagucacuacaauacagugaaacauuagcacuuuuacuccuccuaacaauauaguuguuugcccauuaacuagccucuuccucccaccccagugucucucucuucccuaggagagguaaccacuguacuucauccuuguacaucacacagcuauguggaucacaugguaucagucuuuuugugccugguuuauuuauuacuuaauaaaauguccuucagguauauccauuuaauggaaguaugauuaaauuucuuugguugcuaaauauguguguauauguauguaaacaaaauauuuucuuugucauuuaaucuuguaauggacacuuaguuugauucuguagcuuuugugaggaauacugcagugaauaugggaauaccuguacuucugacauacugauuugaccucuggaucaugugguaauucuaauuaauucuaauaauuacacaagucaagaauuauauaauucuaguuacacaagucaaaccauucuauuauuagguaauucauaauuuuuauuuauguguuuauuuuugaaacagaaucuuagaguguagccuuggcuggccuggaacuuccuauagaucggguggccucaaccucagagaucaguauggcucuuccuccagagugcugggauuaaaggugugggccacuaucccuggccuauuuuuuuaguuuuuuuuuaaaaauauucuucuuuuuucuuuuuuaaagauuuauuuauugaauauauaugaguaugcugucucugucuucagacacaccagaagagggcauucgaucccauuauacaugguugugagucaccaugugguugcuaggaauugaacucaggaccucuggacaagcagucagugcuauuagccgcugagccaucuguccagccccuauuuuuuaguuuuuuuuucuuuuucuuuuucuuuucuuucuuuuucuuuuuuuucuuucuuuuuuuuuuuuuuuuuugagggaacugugugcaguuuucucugguggcuuugcuauaccccacuagaaguagaagggggugaggauucaccuucuacuuauucaaaugcaugaagcuagagggcauaauuaaaugaaauaggucagguacugaaagacaaaugcugccguaugauuuuauucagcuauagagucaaaacaacugcucucaguagaauguauugaauagugugcucaacuaacgcagggcacccuugccaggguaggaaagggaacagcuaaaggcagaaauaccauuagauggcacuuagguuucuuccuguguuuuagagguaggguuuuuguuucuuauuuagcauaacuccuaguaauuuuagaggaaaauggauggaaauaccuuuauuucuacaccuuaaaacuuguaccacacuuuauggaaacgaauuagggugcuacaucuaucaucagucaaacuuugcacaugugcugcgugggaucauuaguauaugucuuaguauauaaaaugcuuuuuaugugcuaacuuauauaacuuaacuguacugagcccgagccugugaauaguagcaucauacauggaauuaguaaguagcacaugccuaguauguacauccuguacucugagcgcucugagauuuccaaggaagaaagggccaguucuuggguuugguucuugaggaggcaguauggaauaggagaugugggagcaggugggguauuucuuucaagccaaagaagcccuuugccguguuauuaugaauuugaauuuaaaaguuuucagcauuaaaaaaaaaacccuaauauacuaaaaaaaagcugcuugaaaaguuuguaaccuggagacagaguugaaauuuugucacaucuguaugcaugaagauaaagaaacuacuguuuguagauggugggaacuaaaaggaaggaauaucugcaggagacuuaaggaaaauuacagauuuggagagucuuuggcugugaaaaugaagggucuucuuuaguucacuuugauuccaaaccauauaaaagacauuuuuacaggcuagaguagacaagguuggaaaaauacugauuuuaugggaaagaagaugagguuauuuguauauauuuaguuaacuuucugugaagaaaccuagcaagcacuguuagaaagaagcauuucuggugaacaugugggauauuauuuuuaacauugguggcgaaaucuuggaaaugaaaagaagcagugugauagcacucaaggcuaaauccuuaagguguugaucagagagaggauggagaaagaggcaaguauacagagauaauggcugugcuugguacacucuacagagguaccaagaacuaacugcugauuuuagaaucuggucaagagguuuaauaaaugcuagagaagucaccaguaccacaacuaaggcauuagucaugggucaguguuucuauugcuguaccucggaacucugggugaucuuauuuauagugagcucuuaggccagccacauuuauaaagcauuuccagcucccaacaggauggccacauucuagggcacaggauuccacaguucacaguugauuuuauguuggugagauguuuacugugcucauuggguuguuauucccuugcucugccccuuaauccuuugggccuuccccagcuuugucuccagacccugcucucagguugagaaaaugguuuuauuuggucuuucuaaguaacacuggucuauuuaagagcgauucgauggccuucuuugcuacugugcaucguaugugauugugcuauuaggacacugcuuacagaaucuuuucuauggcucagaaauucucuuuauaggacaucauggaauaguaauagaaaacaauuccugaaacuaaguuucgacuugggcuucccaagaguuuguuugccuguaaguuuagagucaagugagacaugaauugaaucucguuuuggcuccuuauuuucuuuguaagcauucccaagcugccuagacucuuuaagcaucugccucuccuguuugaaaugggaauaaaagucaugagcccuuuguaguguugcagugaaaguuaaaugaaaggauguauggaacgcucauggcacaggguaagugcacagugaacauuccugucuucaccaucacagccauuguuaccagcaccuucugugucuguguuaacuuccacuagcaguccugauguaucauugagcacuguaggaagagacuggaaaggaaguguucuagugguucauagauaauuaaauugacuuggauauggucccaggaacucaguuguauggcauaugagaccuuguuuucaguguuuuagaacauaggugggugguacugcaaggagcucuugcagucgccccgguuuuggcagagaccccaccucccaguuuauaguguucuuggcuguuaccaugcuccauccacucauucagcacucagagcuuuucacacuguggacauugugcuggauaccaaauugacaaggaagaaugagguguggcuccugcucucgaggaggaaucgggccauguaaacaaaugcaaugaaaauguucucuccaaagacaacuagaagucuuugcaguagagaagggagagagagcugcugguccuggcaagguaaugguaaaaacccucagucugcguuagauagcagcgcacucugauuaagaagccacugugcuguguucuagcgcucccugcucucagcaguguugcuguuacacauggcccaggagcauccuagacaugcuuacuaauuugaaugcuuacccuuccauauauuuggacgaccuuuucuuauauagacauuaaguccuggauaaacagugaagaaauugagguugugacuuuuaaaagcucaguaaauauuauauugaauuucuaauguaucacaaguacuauauaauucuaguuucuaaguuagcuguggugauagcaguuuugggauugaggaauguuaacauaguaauugugacuuuuguaaaaguucugggcugucgauaccaagacuaaauuauuuacucaaauaaaacauuugcuuuuuguugaugaugggggcuuuuuaucagcacuggggauaaaguuguuuugcaccuucacucuuguguuuucuuugugcagggagacucaugcaucuguaugcaguguguguggacugccuggaagggguucacaagauuaucugcaucaaaugcaagucacgaugggacggcagcuggcaccagcugggcaccauguauaccuacgacauccuggcugccucucccugcugucagguugguaucagcugaacugaaggugcaguagauaccuaugggcuuuugucaccaaguuaacuuagagaauuaaaggcugcuuuguggguacuuggcgugugagguaugaggguuuggucaugguguccgucuaaggaauaaaaauucagguaagguaaaauacuguuuagucaaagggaaacacacacauauauacacauacacacacacucacaaagagagggggcauagagagaaguagauuuggaauacuuuuuaucuguuaaaucaaaacuaaaauaaaacugcaaagcaccuugcuuccuuugagacagcaugaaagugcucucugauuaucagcaguuggguagguggcccaggggguuagguaucuguguaugguuucuuuaguuuucauuuugcuuauaacuuucucauuuugugagauuaauuuauacuacaaaucuguaacaaaggguuuuaauuuaaacugaaaaggaaauuuuuuuccuagaacagaaaaaaauucaccaauugcguacuuucugugagauguuugcaaaacccaguaucucccacuuaaguuauaugacauugaccagaaagcuuuauaauuccucaagugcuagaagcagcacuauucuuuccugacuuguaggaaaggaaaggaggaggugcugacacaaaaccccauuaaauaagaaauagaaaccaaagggauaaaaucccaaggaauaccggaauuauuauuauucaacauacuugaggaaggcguauuacauccuucccuggugggugacucuggguagcagauguucucugcuggcauuguguuaacccauauccuuuacagauagugaguauuacacuguggcuacaauaggaguuuguaucauuaccauuguaacuucauuuuuaaaaaauauucuucuaguaucaguuugauuaguaggugaccuguuuguguugaguucaaagccacagacaguaguuccccucuuuuuugcucauuaguguuuuacagaagagaaaugugcuugugagcgagguggauagccuucuuccuaugucuuuugguuuuggauaagguugacuaguucucuuuucuuucuuucuuuuuuuuuuuuaauuggacauuuuauuuguuuacauuucaaauguuauccccuuuuccgguuuccccucugcaaacccccugucccgucccccuuuacccugcuucuaugaggaugcuuccccacccacccacuccuguuucacugcccuagcauuccucugcacuggggcauugagccuucacaggaccaagggccuccccucccauugaugucagauaaggccccuucagcuccuucaguccuuccccuaacuccuccauugggaucccugugcucaguccgaugguuggcuuugagcaucugcaucuguauuuguauuggucagaaucuggcagagccucucgggagacagcuguaucaggcuucugucagcaaacacuucuuggcaucaguaauagugucuggguuuggugucugcaugugggaaggaucuucggucucuguuucacuauuugucucaguauuuccuuuauuucaggguuaaaauuuuggagcugguuggguggccccaucccucaaccuggguuugggggguggagugccuaaccucuggauauggucacaacagguaugcuaagcaucuccaugggauccugauaggcucuuuguuuccuggcaucugggacuuucugguugcuacccccaguugcccaucccccauugcuacacaucucuguugauuuccugacccucuguacaucuccuccaucuccucccauaccugauucugccccucuuuuuccucucccauuccucucuuccuccaauucuuuuccacccucuauuuccuuugauuauauugcucccccuucuaaauaguacugaagcauccacucuuuggucuuccuuccucuugagcuucauguggcccaugaguucuaucauagguauuccacaauccuugccuaauauccacuuaucagugaguacauaccauguguguucuuuugugacugaguuaccucucucaggauauuuucuagauccaugcauuugccugcaaauuucuugaagucauuguuuuuaauaggugaguaguauuccauuauguaaauguaccacauuuuuuauauccaucccucuguugaggaacauauggguuguuucuagcuauuauaaauauggcugcaaugaacauaguggaguauguguccuuauuacauguuggagcaucuucuggguauauacccaggagugguauaacugauuucaaauuucugaggaaccaucagacugauuuccagagugguucaaccagcuugcaaucccacuagcaauagaggaguguuccucuuucuccacauccuugccagugucugcugucaccugaguuuuugaucuuagccauucugacuggugugaaguggaauaucuuguuuugauuugcauuucccugaugacuaaggauguugaacauuucuuuagguauuucuauuaaggaguagagauuguugcuuccuauuauuuuuguucuuagagguggaauuauguuuguguggcuaucuucuuuuggguuuguugaaggaagauuacuuucuugcuuuuucugggguguaguuucccuucuuguguuuuccaucuguuauccuuucuagaguuggauuuguggagagauacuguguaaauuugguuuugucauggaauauccugguuucuccaucuaugguaauugagaguuuugcuggguauaguagccuuggcuggcauuuguguucucuuaaggacuguauaacauuugcccagaaucuucuagcuuucauagucucuggugaaaagucugguguaauucuuauaggucugccuuuauauguuacuugaccuuuuuccccuacugcuuuuaauauucuuucuuuauuuagugcauuugguguuuugauuauuuugugacuggaggaauuucuuuucugguucaaucaauuuggaguucuuuaggcuucuuguauguuuauggacaucucuuucuguagguuagggaugauuucuucuauaacauuguugaagauauuuacuggcccuuuaaguugggaaucuucucucucuucuauaccuauuauccuuagauuuggucuucucauuguguccuggauuucauggauguuuuggguugggguuuuuuuacuuuuugcauuuucuuugacuguugugucaauguuuucuaugguaucuucugcaccugagauucucuuuucuaucucuuguauucuguuggugaugcuugcaucuaugacucuucaucucuuuccuagguuuucuaacuccaggguugucucccuuugugauuuuuuuuauuguuucuauuuccauuuuuagauccuggaugguuuuguucaaucccuucaccuguuugguuguguuuuccuauaauucuuuaagggauuuuuguguuugcucuuuaagggcuucuagcuguuugccuguguacuccuguauuucuuuaagggaguuauuuaaguccuucuuaaagagaugugauuuuuaaaaucagagucuugcuuuucugauguguuggaguauccagggcuuugugguggguagguucugaugauuuuaaguggccuuauuuucuuuugcuuauguucuuaugcuugcuucuuaccaucugguuaucugugguguuagcuggucuugcuaucucuuacuguggcuugucccuaagccugugugucagcauuccugugagacuagcucuuuccagguggaauuuguauauggagaacuguggcacagggucagcucugggugcagauggaauccagaaagauucuauccucagcugcuucucaguuccuguguccucauuagggcuccaggcgggucccucuugggccagguauuugagcaaaagugguguucucaccugugcucucaggugugucugcacuccuggaagaccagcuuuuuccaggugggauuuggguaugaagagcuaaggcacaaaccggaagaccuuagucuccuguucuggugguguucugaccacauuuccagauuccagguuagcuuugauugaguuacugugaucuuccaguuacucacugucaugcuuuaguguccauucguaagaugauagaaaccaaagggaguguggugccuuuucuguguacauagaugauguagcaggaggguuagccucuuaaggaagugaggacaugaacaaagauuugggcuauauuaaauaaagcucauggcauuuuagcauugcaugggaccuugccagagcucauucagcuuucugaauggaugcuuauaauggaugacucaagguuuugaaaguuuucuccagaucuacauaaaucgugucacagcugugacuaaaacaugugauuccuauucugguguucuuucuacuuguuguugaacggguguggcauuuccauguauucaguuagaaauacagacuggcaucuugcccaccaauccuuuugucugcacuguauguucauucuugaaacugauauaugccaagauuauauuuucugucccucaacugaaacagaaaaccuguuugauuacuguuguuguuguuguuguuauuauuauuauuauuauuauuauuauuauuauuauuaaacaauugaaaauauucaccgugaagauacaccuuguagacaguucucaaguauucaggaaagucuucaaauaagucugagccaacaauaaguaguauuugguuaucugaaaagaauaagagguuagagagaacuuuccugaagacucagagggaugaaguaguuaaaagagaguucauuuuaggcuuuggaaagauagcguguguaggugaagugugcacuuuggagcacauuuaguuuaaaucccagcuguucagcuuucuguuuucuugggcuugguauuuaucagugugugccccuuucaucaucugaaaugcacaucaugcuccuucacaagaaagccuugaggacagauuuguuagcagauuuuuaggaaggcucuaaaucaagacuguuuggucuguaauuucugccuauccacugugcucccagaucuauugcugaagugcugcaggauggugcuguuagaggcacaggcgcaggugaagauggcaugugauagugaauuccagacucucaacauacacaacacucuugccugcauugcccauuuugcuuggauauuuuagggagauuuuacuuuuauaucaaagaaaacugucauauagagacaaaugacaguguauaagagcuuuugaaauaaaccuggacucuucaggaaaguuuuuuuuuuuuuuaauguagauucaggugcaaauagccauaucagccagggagauguugauugcuguuagguaacucuguugguaguacuguuuagaauuuucucauugguaggcaccucauauuaagagagaaacugggagacuguagucuuuagaaggaugaugacgaaugucagaauaugcaucuuagauguacaugccuugauucugcuaauaauggagauguuucgcugaaucucagucaguucccagcauuuugauuagguggcuuuugacuauauuggguagcuagugguauuguggcuuaugaugucuguuuccccaggcccgucugaauugcaagcauuguggcaagccugugaucgacguacggaucgggaugcaguacuucucugaguacagcaauguccagcaguguccacacugugggaaccuggacuaccauuucgugaagccauucucuuccuucaaaguucucgaagcuuauugaugaaagcuuugcuuuaguaauagcuauuuuauugauauuauuacuuuacuacauaucuuuuauaggggaacauucugugacauuaauuucuuuucuaauuugaagcagaguuuacuuuguauauuugugccacuaaaauggggacuuccucuugcccuuuccugauucccaaaugucaauguguggguaagacuggaggccagauggggaauugugcagguuugguaggguuuuagucucaugcagagugucugauggaguucuaagguaguaggaagaaugggugccauuuaggggugggaaucuggcuaaacuagaggugugguaggaguugggagggagcuuuuacuaaauguuagcuuucuugagacucacuguuaguucucugggccuuggggaaauaaaugacaagugaauguacaccugagccuggacagccaguacuguauuaggcugucuggacucuguuuuucagcacagguugaggugcaauuuucucccacugauagaugauuugagaguagaacugagugcucuuucuuugacuauuugucuaauuuaacaguuuucauacuggaaauaauauccaaauuauaugacacgugaaagcuguugcuguguaggugagcugaaucuagcaggucuugugaagcaaauuuggaaaugaugcacacugaaucaggcaggcagaaagacacacuuugguuauuugaacuguaucucuagagguggucagagagucuacagaaaaucuguauacucggugguuuugaugggcagcauuuacagguugcauugcugaagugcugccugguauccagagcuccuugcagguaaaccucuggccugccugcugugcugcagaaccaccugugccacacuuccuuuucaguauaucuagugccacauagucagagccaaucugaagaaggaaggcgacaguuagaaugaugaauaguuuuuauucuuuuaaaaguaaguucaguuuugggagcaguaaugcaaaagagcauaucugaaaauagaucauccuaaagauucccaugaucccucacuguugguuaaagcaaaaguagcauacagaccaaguauuccaaaccaaccucugugcaggagaauguggaaacuucaauaugcugaagacauggccuguacaguuagaauuagagacuuacuucuuaugaagcaauuugguauuuucaaguaugauauagaaguacauauuaaaagaauacuaaaucuuacccauuuaugacuaggcaaauuugaaguuuauguaaauauuuauaucauuuuuuugguuuaugcccccuacacauacaguggguguuucucuucaaaauugucuaagcauuauugccagugaguuuuaaauucuacugcuuggugauuugauggaaucagcauuaaggaacccaacuaaaacucuucaucuuuggaugaauauucuucaucaguugguuuguuacucauaguuugaugaucugaaguuucacaucuguaaaaacuugccuaggacaagcagaaaucauuauuggucaggugguguuuaaugcaauuacaugaggucuacauaacauaauacuuacaaauuugucuccgaagcacaaagcuguaauuaggaauuagcuguuucccuaugagucuguuguacacucaaguuuaaaauuuugguaaguuucuauucaaauucauauuugucuucguguuucugauucuuuuaaaauaaauaaaauacuuguaaugca

SEQ ID NO: 12452 - RNA, 3242 nt, Mus musculus
caguucuuuggcgagccggcucccgggagcguauaaaagccagcgccgcccgccuagucucacacagcucuucucuccaagaagacucagccagauccacuccagcuccgaccccaggagaccgaccuccuccagacggcagcagccccagcccagccgacaaccccagacgccaccgccuggagcguccagacaccaaccuccgccccuguccgaauccaggcuccggccgcgccucucgucgccucugcacccugcugugcauccuccuaccgcgucccgaucaugcucgccuccgucgcaggucccaucagccucgccuuggugcuccucgcucucugcacccggguaagccccgggacugacggaagggacggagggagggcagagugagcugcgaucacagacugaccucccuccccuuccucuccgcagccugcuaugggccaggacugcagcgcgcaaugucagugcgcagccgaagcagcgccgcacugccccgccggcgugagccuggugcuggacggcugcggcugcugccgcgucugcgccaagcagcugggagaacuguguacggagcgugaccccugcgacccacacaagggccucuucugcgauuucggcucccccgccaaccgcaagaucggagugugcacugguaagacccucagccccauuccagcccccuuugcagaggccucaccuuuugguguuggaccaccaccucucucaaguccagcgugauacccucuagaaaaagaaaagccccuauccgcagcugcuuccaaccggcccccugcaguccugacccuagcucgucaccuugacauguacagugauauagcuagcuguucugaucccugugacccuacgccugaccuacaacuuugucuuccucucccgcagccaaagauggugcacccugugucuucggugggucgguguaccgcagcggugaguccuuccaaagcagcugcaaauaccaaugcacuugccuggauggggccgugggcugcgugccccugugcagcauggacgugcgccugcccagcccugacugccccuucccgagaagggucaagcugccugggaaaugcugcgaggagugggugugugacgagcccaaggaccgcacagcaguuggcccugcccuagcuggugaguugucaccuucaaaguuacuguuauucauucuccccaacuucagggccaaugcccaaguccaccaaauuaaggggaaauuguccuauccggauguuuuaccuuguguuuguguguucugcucucacagccuaccgacuggaagacacauuuggcccagacccaacuaugaugcgagccaacugccugguccagaccacagaguggagcgccuguucuaagaccugugggaugggcaucuccacccgaguuaccaaugacaauaccuucugcagacuggagaagcagagccgccucugcauggucaggcccugcgaagcugaccuggaggaaaacauuaagguacauccucugccccuagucacuccguuuuacagaaugacagggaagagaaccgagcuggcugucucaccucccauguuauuagaggccuguugucuccagaaauaucuaaccauggagcugucuggcuagaaugagagaugcuguaacaacagcugccaguuuuccacuacaaaauuccccguggugcuaguuaauucaagacacuccaaaugaggccauggcuauuuuuggaaaacuggcaaaugaaacucccagucucuccccucagaauauaaacacaagucagaugacauagggcuagucuacaaaggcuugaggaaggccacucccguuguaguaauugcuguuucuccuucugucuuccuuagaagggcaaaaagugcauccggacaccuaaaaucgccaagccugucaaguuugagcuuucuggcugcaccagugugaagacauacagggcuaaguucugcggggugugcacagacggccgcugcugcacaccgcacagaaccaccacucugccaguggaguucaaaugccccgauggcgagaucaugaaaaagaauaugauguucaucaagaccugugccugccauuacaacuguccuggggacaaugacaucuuugagucccuguacuacaggaagauguacggagacauggcguaaagccaggaaguaagggacacgaacucauuagacuauaacuugaacugaguugcaucucauuuucuucuguaaaaacaauuacaguagcacauuaauuuaaaucuguguuuuuaacuaccgugggaggaacuaucccaccaaagugagaacguuaugucauggccauacaaguagucugucaaccucagacacugguuucgagacaguuuacacuugacaguuguucauuagcgcacagugccagaaugcacacugaggugagucuccuggaacaguggagaugccaggagaaagaaagacagguacuagcugagguuauuuuaaaagcagcagugugccuacuuuuuggaguguaaccggggagggaaauuauagcaugcuugcagacagaccugcucuagcgagagcugagcauguguccuccacuagaugaggcugaguccagcuguucuuuaagaacagcaguuucagcucugaccauucugauuccagugacacuugucaggagucagagccuugucuguuagacuggacagcuuguggcaaguaaguuugccuguaacaagccagauuuuuauugauauuguaaauauuguggauauauauauauauauauauauauauauuuguacaguuaucuaaguuaauuuaaagucauuuguuuuuguuuuaagugcuuuugggauuuuaaacugauagccucaaacuccaaacaccauagguaggacacgaagcuuaucugugauucaaaacaaaggagauacugcagugggaauugugaccugagugacucucugucagaacaaaugcugugcaggugauaaagcuauguauuggaagucagauuucuaguaggaaauguggucaaaucccuguuggugaacaaauggccuuuauuaagaaauggcuggcucaggguaagguccgauuccuaccaggaagugcuugcugcuucuuugauuaugacugguuugggguggggggcaguuuauuuguugagagugugaccaaaaguuacauguuugcaccuuucuaguugaaaauaaaguauauauauauuuuuuauaugaa

SEQ ID NO: 12453 - RNA, 43415 nt, Mus musculus
cgacccuggcucucacccgucugucgccggguuccccgggagcccggggcucgaugguaccgauggagacgcaacugcagagcauuuucgaggaggugguggugagugccacuguccguaagccagagccauggcuccgggaagugcaggcugcgugcggcuccaggcugcgggccugggccagcuccuuucccgccccuauguugacauaggcgucugaaccgggguggcgguccccccauccccggacugcugccagaucuaagaaagugcuguuaguucccgccgcgguccccauaaaagugucgugcucuaucuguauugcccgggaauauuucucucggggacaucucccaccccgcccccuuuuaguagucagaucguuuacuaguuuuuguuuguuugcagaaaacagaaauuauagaagaggccuucccagggugaguauguggcaggcagaucuuuguguguguguguguguuuuuuuaauuguuguuuguagauuuaucuuuguuagauuccacuuaaguugguuuugaggaguuaaaaaaaaucuaccuugcaggauguguaccuguuuaaaacuagcagcagauaaugugauuuuuguuuuuucagaauguuuauggauacccccgaggaugaaaaaacaaaacuaauuagcugcuuggcggccuuccggcaguuuuggaguggacuuucucaggugagacauuucauguugaacauccacuuaaugacguuugacgccuuccuuuuuacuuuuuacaucuucuuugaucuuuuucuuaagaucguuuaggaaagggaaaaauaagacugcugucauuuuauguaaauguacuuacuggagaaccuguguuaaaaguucaagguaauaagauugcagugggaaauguuuuaaaaauuuccuucuauguuauauuauguaagguaguuuuuauccucuuuguauaaauuggcuuugaauggaaacagauaugcuaaacuuuucucguaaaagaaaaaugucacuauucaaaaaauggcccaguauuuauaaauauguccucauaaagacacugugauagaguccccacuagaguaguauuucucaugaugcacuguagacagagaagugagccgcugggcuuucugugccugugagcuaguauaaaauuugccacccaguuauggauccuaaaggcaauauguucauguuuuaaacuuucuauuuucaacaggucaugcuuugacgugaaccugaaauauauaaggcaagcgugaccaagcuccacacgcuggccgucuuccugaucuagcucagccaccugcccuuccugucugaagccagcauccuaguuuguguucccagaacuguuuagcuauaagacugucucucuguguccugaguucuaggauuauaaagccaucuucguucuuuucucuuuaaacagugcugggguguggggggugaacacagggccucacacacuggucuccgaacaugugaacauguguccacaugcuaggcacacagucgucucugaacuacauccucaggcucacaauuauuauuacuauuauuauuuucugcuuuuugaguucgagaccacgcuggccucgaacucagaaauccaccugccucugccucccaagugcugggauuaaaggcgugcgccaccaccgcccggcucagaauuauuuuuauagaaucaccauauaccauagguauuggucagcaguuagcucuguacuucucaccauuaauaauaaguucuaaagguauuucaaggaauuuuuugaguuacaguuucuuucuuacuucuuauagcgguguagcauauuguuauguguccuuaccaccuauauuuauuaacuaccuucuugcuuucaaauuuuucuuucuuuuuuuccagauagaguuuuguuauguagcccagguuagacuugaacuuuuagucugccuuccucugcuuccuggugucauaggauagaccaccaugcuuagcuagauguuucucuucacuuuuuacuuacuuugggugugaguguguguguguguguguguguguguguucaagacaggguuucucuauauagcccuggcuguccuggaacuuuguugaacaggcuggccucaaacucagaaauccgccugccucugccucucaagagcuggaauaaaaggugugcgucaccaccgccggcccacuacuuuuuuuuuuuuuuuucgagacaggcuuucucuguauagcccuggcuguccuggaacucacuuuauagaccaggcuggccuuaaagucagaaaucugccugucucugccucccaagugcugggauuaaaggcgugugccaccacugcccggccggcccacuacuuuuaaguaguguuacaguaaguaguacuauugaucaggcauaggauugaauauugggcauaauauugguauaaaucaaaagcuuuuuuuuuugucuuaguuauggaggggagguguauaacacacaugauauaaucucaguguaacgcagauuugccugggauuugaucuguaguccagauuggccgugaacucaugacccuccugucucuauguccucaguacugagauauacgcauucauaaucaccccagcaauuuauaauuuuaaggaaauuaccuaauuauuucuuauaaggguuaucuaguuuacauuaucaauaccaacaaccaauauaauuuccugaaggcauauaauaaaauaguaauacuuucuuauccuuguguaucaagcacugggaaauuuuaucuugguaaaauuuacuuuuuaucuuucaauauuuagcacauuuuaugcauuuuuaauuuuaaaauauuuguuggucuuuuuauuuuaacuuuguguguguguauguguguuuguguguguguguaugugugugacaguacuuguguacaggucagaggacaacuuacaagagagagucucuacuauacggacccugggaaucaaacucagcaagugccaugccugcugcaccccugucaggcacauggaauugcuaaagucauuuccuaaggauuuagugauuuaugcuguggccuuucaagauguuuauauagugagagagaaagauacaaauacaauuggcaauucuaaaucagaugauggguggugaucaucuggaggagcaagguguguagauccucccaggaugcucuggaaggcaggcuucagugugagcauggcuuugguaucaagaguuaacguagggaaacuagaaguucgauuuuucuuuggauuauggugggcucugauuuggguucauggggauuggagucauuuaaauauucacagugaaauauuucauuuacaguauugauagauuuucagguauaauauuagcauuuguguuacuuagaaauuaugacuucaggcccaaaauaaaagugucuucuaauuuuuaggagucucaugaacaguguguucaguggauuguuaaauuuauucauggccaacacagccccaaaagaauuucuuuccucuaugacugcuuagcaauggcaguugagacuggucuccuuccacccagguauguuuggguggggaugaacgguggaaagaccuuugguuauaaaguugcggacuugcuuugagguuguuauacagagacaagagaugggaaggggcauggagcucauaugucaguugacucaugaggcagggcuuuuguuuuaaauuuguuuuguuuuuauguauaugcacuguuagugauugccauguauguaguguuccugaggaggccaggagagggcgcuagacucccugaacuggggcugacaguacaacagcauugugagcugugaagugugggucgucuccagccuagugcuuguuuuguuuucauaguguuucauaauuauaguuaguguggcgaagacugaaauccuugcaaagcuucccacacucagucuacugggaaccuguauuggggcuuucauccaggugucuacuggugacuacacuggugacuacggugucauccugggaccuggcuugcucccaggcugguagaauucaaaaguuuguaauaagaaguauagucaaguagcuucgagucuuugccauagccuuaagccugcucagauaacacagcccaucccucuaccucucugaggcauguguaucagugccaugcuucacagaaguauaugggacugcacugcagucaucuugacaagaguacagucugccaccaccuaguagaugauaaacauuaccaacagcuuaugagagugcuuuuuuuuucccuaguaaauaucauuuaguucuacucaauguuugagcuuucuucuaaguaagaauuaggaaguauuucauauaccuggaauacuuuaacaguauagauuuagaaagcauguuuggcauggcacuuuaacaguauagauuuagaaagcauguuuggcauggcacuuauaauacucagcaucuacaggucauagccguagagaaucuuuaggauucucucuuguaacugaauguucuuccccucucucccccccaggaugguuugugaaucuuugauaaacucugacucucuugaaugggaaagaacacagcuuugggccuuaacauuuaagcugguucggaaaaucauuggaggaguggauuacaagguauuauuucuuaauuauaaaaagugauugcuuucugacaugaaucuuuuuaaaaauagggugugaaucuuacuucacagaaagaaagcagagaguauucauaacuugacuuuuugcauaugugcugaagggauuuaaaacuauucaacuggcuuacuguuuuuucccucccaacauuuuaaaagacacacaggacuaauauauuuuuaugaugaaaugggaagucacaggcagaauccauguuugaugccagaguucuuugucuugugagaugaagaacacagagugggguuuguuuucuacguuggucucuuuggaauuguguccuuccuuacuggaugucuucaggguucugcagcugaccgagcacagcagcagugcugugucuccuuguacuucaagguccggucaggagugucacagcaacagcugagagcaguuuucuucauguacuuuuguuacugucaaggaauugccaguguguggccuuaugcuuuaugucugcauguucuucaaucugaaaugauccaguagugaccccagaucagucacagcagacuucucagguccccagagugcuacucaacacacaucucugcacagagcaaagcugugcuuucuuacaaagaaagaguagaaacccuuguaagaguuggaacccuucaucuauuuuugccagaauauaggaaguuccauuuuacuuuuaagugauuuucauuguucaugcagaauuuuguccuauuauagagcauuauuauucucagguuaguauuaguaaugaauuggaaaagucuaaaagugugaccuagaagcaguguauacuucugacaccuggcuguugugucucacauagagacuucacacuuaccuuuuggcuugacucaacaucuucuugucuucuuuauacucaucaggguguucgagaccuucucaaagcgauuuuggagaaaaucuugacaaucccaaauacagugagcucugcuguuguccagcagcuucuggcagcaagagagguaaucagaauguaaacaugccacccacgucuggguuuguuuaugugugugcuuuuaaagcauacaguggcuggagcuggggagauggcucaguggggaagaacacuugcugugaaccaggagaaauaagaguucaguaaagaagccaggcaugcacccugcugcccaaugccauagcccuguguuguggcacagagacaggcuggucagugagccuggcagaaaccauuaggaugacacuugauauuuaccccucuccucugcaugcacacacugugcauauaacucacacagcacacacuaguaacuugcaauaguuguagaauauuuaguuccuucuacugaaauaaaaucaguucuguuuuuuaaucaagucaucugcugcugagcuauaucucagcccaagucauuuuuguuuucagagauuuuugcuucauugcuccuggauugcaaaaggaaauuuuaaaaauuuaauuucugcucaauaguuaugaaaggaguauaaaguauuuuaaaucauuauaagauaguggccauguuuaucuuuuaaacuauuaauaauacuguaauaguuauucuuuuuucuguuaccaucuuaaaucuaugacuauuuaaagcauuuuaagguauuacuacccaaaaugcauucuguuguuaauacccuucauucucuaagagaauuucucugcuaauauuauauuuuaaaauaauaauucugcuuuguaaaagaaugugcacacauguacauaugugugcauauaccuuguggaaugguuaagucaggcaguuucccauaguuuaccucagucuucugucuuguuuuuugagguaggguaucauguaacccagcuggcucugaacgaauuugcagcuuaggugaagaucggccugagcuccagauucuccugucuccaucucccaagcauugcgaucucagacacaaguuccuuacauacauuuaagaucuugguagccguuuucaaguucauaauguauucugauuaacugcagucgugauguauaacagaccuugaauuuauuccuccugauuuccagaagugagucuuuuuuaaucagcauguugagggcucccucccacacagauacaagcacacuuugccaacuaagcuauugucccagccccauuuagucauuuguaaauauacuuuuuuguuguugccgucguuguauuuauagguuguuugugugagccuagucaagaauaaugcuuuuugcuuguuuuagguuauagcuuauaucuuagaacgaaaugccugccuauugccggccuacuuugcagucacagagaucagaaaacuauauccugagggaaaacuuccacacuggguaaaauuuucauuuucuaaaauuuuaaauuccuaucaagauguuauauaauuguauugcuuguauguacacauacugugugugugucugucugucugucugucugucuuugugucugucugccuaucuuaguuagguuuauauugauaugaaauaaacaccaugaccaaagcagcuaaggaggaaaggguuuauuuggcuuaaacuuccauaucauuuugugcuaucaaaggaaaucaagauaggaacucaagcagggaaggaaccuggaggcaggcgcuucggcagaggccaaggaggccguggagggugcugcucacugaccugcuuucgugguuugcuuggccugcuauuuuacagaacccaggaccaccaguccaggaagggccucacccacaguggguuaugugaucacugagaaaaugacuugcagccucaccuauaaucuaauccuauggaggcaguuucucaccgggggcucccuccucucagaugacucuagccugugucauccuuacauaaaacaagcaaacacgaaccguaugucugcacaugccgcagugugaguguggaguugggacgcuuugaaaguugguuuucuccugugucggagggacucagcauuauguuagcagguuuucuccugugucggagggacucagcauuauguuagcagguuuucuccugugucggagggaaucagcauuauguuagcagguuugcacagcgaaugauuucaccugcugagccuuuucaucucacagccccuuugagaagguaauuacguauuagagugaacagagaacucgagacugggaggguuccaaaggaagacucaggucaugugcacauuuucacauggucagguauccuuaggcucuacauaguuuacuuaauguuuauuugggguaggggcagucuguguaccccguguaugugguuagaggucaguuuucuugucucccugugcuccggaucacugauauuucaggcuuggugccaagcaccuuucccucuugaaccacggcgcugacccaggaaaugcauucucuuuuuagcguaacauauucguuuuguaucucuauuaacccauugagacaguucuuaugugcuuaaaaacuacaguuucauugacuggguaaggaugcaguggugugacuuggcucaacuuagggacacauggagacaaguguuuggaagaaaaagaaagagcacucgucucuaaguaacugccugugccaggcuuuguacugauucuguguaguaucugaacuuccauagaugaugcacggagaugcaggauaaccuuguuuguguauugauuuauuuauuuucuuuuucuuuuaguuacuaggaaacuugguaucagacuuuguggauaccuucaggcccacagcaaggauuaacuccauuugugguaagauccauuuaaaggacacuuaguguauuacauaguaccuguaucguuagugggcauagcugaagggcggccucuuagggugacucgccacuuugacacucuaggagucuaauaaugacguuuacuuuuaggugcuuugauuaaggcaaagacagcacucauagacuugggcaucucucacauacgaccauuccaacaguuggguuucaucugacuagaaacacguuuuauuuuauuuuguauaucuuaguuagccgggcacccuaucguuauauuuugguuuuggcuuuuuuagacaagguccuuaaaaucaaggcuagccugagauuauguaagcaagggugaacucgaacauuugauucuccucuguccaacucagugcagggguugcaaacaugagcugccacacucaguguaugugguuguggggagagaacccaggacugcgugccugcugaagaaucuaccaccugacccuauuccuggccccugaaaaugcuuccuaaacucaggaccacuggaaaugucagcuagguucuucuguagccauaguaaugagaauucgagacucuccagucuauuguaacccaggcacuguaaccuaggcacuguaaccaggcacuguagcccaugaacuguagcccaggcacuguagcccaggcacuguagcccaggcacuguagcccaggcacuguaacccaggcacuguagcccaggcacuguagcccaggcacuguagcccaggcacuguagcccaggcacuguagcccaggcacuguagcccaggcacuguagcccaggcacuguagcccaggcacuguagcccaggcacuguagcccaggcacuguaacccaggcacuguagcccaggcacuguaacccaggcacuguagcccaggcacuguagcccaggcacuguaacccaggcacuguagcccaggcacuguagcccaggcacuguagcccaggcacuguagcccaggcacuguagcccaggcacuguagcccaggcacuguagcccaggcacuguagcccaggcacuguaacccaggcacuguagcccaggcacuguagcccacgcacuguagccuaggcauuguaauccaggcacuguagcccaggcacuguaaccaggcacuguagcccaggaugaaggaccugccauggccuugagcacauuuacauggaaauauuuuuguaaugcaugcaggccgaugcagucuucugccaguugugaacaacucgggagccaucuguaacucauggaaacuggacccugcaacucugcgauuuccuuugaaaggccuuuugccauaugauaagguauguuuuaaauccaguguaggauuggccaucuaagaauaucuauccuguuuuuucaaguauucgaugccagauugccucucucucucuucuuuuuuuuuaaagauuuauuuauuuuauuuuaugaguacacuguagcugucuuuagacacaccagaagaaggcauuggaucccauuacagaugguugugagucaccaugugguuucugggaauugaacucaggaucucuggaagagcagccagugcacuuaaccacugagccaucucuccagcccccaucagauugccuauuaauagucuagagaaguaaauggugugugcuucuguugugucuuugguuucugugucuuugcuagggucuugcuguguagccuuggcuggccuagacgccauagucagccuugagcugguauggucccuuugccuuugcuguuaaguguuggcacggcagcugugccaccagcccugggcuuaggccaguccacuaccccaguguacucuguagaguugcuucagucguacaccucugguuaacucucuuuacguagaguucuugucuaaggcucuacauuuaaaaaccuaaugacuccggauuugaacucaggacacacacacacacacacacauuacuauucuguuggccuuuuaccguugucauguuuggaaagaguaauuaccuugaagagaacauuuggaaccauauccauucgcuuugguuagauuucuaagcagaaaauucuccuucuagugauguuuauagcaaauguggucaaggcaaagagggugcguuucuguaaucacugaaauuggggcauuuuccugcugaggagccgcagucccuaacuacauuccugagcagcuugcagacugugcuggcuccagucuaguugucguuaggacuguaccuacaaagcuaguugcugugguucauaucccuagaacucagagcgaugaggcaagaggucacugugaggcccaggccauccuaggucucaaaguaaguuuuagaccagagcaauccugucucagaaaagcacaucaacacuugcuauacagcuucuaugugaagcagacucugcuuauucggucuguaaaugauccauguauguuuauaugccacaugaaugcagugcccguaggggucacacagaggugucagauccuccacagugagaguuuuaagugguugcgagcugcccaguugguacuagaauugaauccuggcccucuggaagaucagccauuccuccagcuucacaaggaauccuuuaaaaugauuacuugaagggcauguguguaucucccuguuacuaagcacaaguggaggacagagcauuaagcacauagagagcugggugagcugagggaugggggucuauugaaaaggaaaaaucauuuaugaaagcaauaauuguucuuuaguuuuacuucacaguuccacuaguacagguuuuaaaagcauaucuguaaaaucaguuuaaagccaggugugguggcacacgccuuuaaucccagcugaugcagaggcaggcagaccucugaguuugaggccagccuggucuacaaagugaguccaggguagccagggcuacacaaagacaccuuaucuuaaaaaacuacacauagacacacacaaaaaaaucaguuuaaauugcucuccccugaccccauuucuucuagaauuccaucuaagagaucuauaaaaaauugcaaucaagugaccauuauacagauagaugguuucugaaguaaacuuugcagugacuauccaagugacggcucuggcagcacauacagaaguaaggauggggcauguguuaggagacugauggcggcucagacacugcagcuaauaagcagauucagaguaagccucaacagaaucucucuacacuuguaucaugucccagcucuguuagagugagcugacacaggcauagcacugcucucccaaacuggguuuaaauaugacauuggccacuuuggcacaggacccagcagcuuauacugagggaguccaagauacuuauaccacaccuguaaccucagaaaaggguucuaaguuuggauguaccuuuauagugguaguucuguaaacuagauuuaauuuaagaaauucugugggccuugggauauauauggcucaguaguuaaguaaacugacuguucuuccagaguccugaguucaauucccagccaccacaugguggcccauaacuaucuguaaugggauuugaugcccucuucuggugugcagguguauaugcagauacagagcacucauacauaaagauaaauaagaauauuuauaaaaaaaauuguguguuuaguuacguagaaacuucuggaaaauugucauuuugcacagaaaggaaauaaagaugcuucauuaugucuaauaaauauggccaaggacaaaaacuuaccuaaacugacaacuacagacuugacauuguaaggacagucucugaaggggaaacuaaauguuuugucuucaggaagaggggaaauggaaagguccgacucaaguguugucuucacuuguaacccuuaagaggccuugccaaaggcuuccaccuugauuuggaaaugagagagccaagguagaaaccuagccugcaagcaauaaaugucauuuucccacuagauuuggccuacuaugggaagguaaaaagugcacgaggagagucuccucuuaauuccaaacaguuugaauucaccuuuguuaaucuugaagcaauaauuucuuuuuuauuuccuuugaaggaucuguuugaaccgcagacugcuuuguugagauauguacuggagcaaccuuauuccagggauauggucugcaauaugcuagguuuaaauaagcagguacuguaccacgcugggagccgugaaucuagacccgcacucugcuguuuccuuugcuguagcucaccgggcaagacaguuaaggacgcucugacgaccuuugcaguacacagguuacucagcaguguauucuauaugguuuauauauauauauauauaguacauuaagaauguguacauuuaaagggagguauuuuuaaaauugguuuguuuugcauugcuuuuuuccuauaaggccaguuucaaguucccuuuugccagagaaaccuacacaugacuuaaccauauuuuuugaccuuuuguuguuguuguuugguguauuuuuauaacccugauauccucagaguggccgccuugcugacuuuuccuuuuuuuuuuuucuuuuuuuuuccccucucuuuccuuuuggcgugucggugguugacgugugggcggguuugugcugacugggguuccuugaggcuggccucauagucaccguuuugucucuucuuuuuuucuuccuuuauuuuuguucuguccugucuuguccugcccauccuccaaugcucuagaccuugaacauugcucagguauguucacaaccuuacuguuguauugugacuaacgauacgcuggccgcuuuguagccgcugauucauuuagacaguacguguauggucggggcuugaaauuggcgggaccaugcugagaccaaggccacugaaaaccuucuugggaugugagaguucuuuuugguggaugguuuuugguuuuuugugguuuuuugaaauauauauauauauauuugaaauauauauauauguauauauauauauugguuucuuguuuuuuuaaagaaagagacaacacuuggcacucaguaagccugucaguuuuugaucguuuuuaccccccaacuccauuuuacuguuuucauuuuagggcuaaaguuagccugauggaauuuucagaguuggaaagauuggugguagccucaugucuuuccaggcuauuaacaaaaacaaauaacaacaacaaaaauacuuguguugauuugccuuaaaaaccaaaacaauuuaaaaaaggaaugaaaaauagaacauuuucauagagauacgcugccuucaaaagucggagugguaagcucuaaagagggaaggcuuuuuggaaacauggggauugacuaagaaaugucacacucuuaggugaccccacaccucuuugucagucuuugccagaugugcccuucucuuagagcgggcuuuucaggaguggccugccuguggcaggagacaaccacugugcuacauccaguaagcugaacucugcugcagcccaggccauucugggcuucgcaccugugagaguuuaagcacaauagugguccuaguuaauuuuuguuaaccguuuuugagcccagcauauuaaaauugagcagcuuuuugguuuuaagaagaggcucuuucuaggcucuguaaaguggcguugcuguuugcaauaccauagugaagguugugccagugcuuccauugauaaagcccuauuuuuacggacauacggcuuggccauaaaccuugcucaguguugaaacugcaugccaaacucaccacaguagcaauaccuuuuuuuauuuucaguuuuuuuuuccuucuaaaaaauuaccaaguuuccuuguuuagaagagccuuuguaaagcgaaacugaaauucccugaccaccaaagucccugacaguuaccuucuguaaccugucacauuaacucugacccgcuuucacuugaguuagagguaaguauuagcuaacuuugcaagaaugcuucacucuuugucugaagauuaaguuugaguaagcauuacaccauacuugacucauuccucuuauaauuugguggcuaucggucauugaagcugcaaguacaucccccagauagccuuagcuaccuaugacucccuccucccccagauagccuuagccaccuauggcccacuccucccccagauagccuuagucaccuauggcuuccuuccucauuggaggaaggaggcagcuguccucaaaauagaaacugacaaaauaauuugagaagaguuuuuaugaucugaucauuuuaauaacaaguuucaaccuauaaaaaguuuaugacuaagacauaaauccauaaaaaauaaaguuuauaauggaaaugcugacagaacauuauuaguauuggucccaccauagugucaacauugucgaaacuucacgauucaucaguaacuguugucuuaggcagcucuguagugaggggucuacagaugcaagguaauaugccgaagugccuugguggauuauuuuacauguggaaaggaggguauggaaggaaaaccagcaguauaaauccauaugacuaaaaugaauccagccaucuuauugcaucucuuaucaucacagaacuguauacccuaugcuguacuuucuuguccuuucucuaacagugcaauaauuaaagcuuagagacuuuaugaccuguccacauuacauuuuccaguaggaauugggcuaugguuaauccuaaaauuggucacaggucauaacagcccaguucuacagccacagcaguauagcguguugagcuugaacagcaguggaaaaagaggaacguuguguucuggguugacauagaauuucuaguguuuuuuucuuaggaauaaacgcguucuaagucauguauacuuccccagcuugucugugcugggcauaggagcgaguacuaacuggcucugguuagcagccuccuugguuaaaguagggauuaauaaaauugagagauuuaguccucccaacuuguucugaagacaguauuaaaauucauuuaaguuacuauuuagaauuaacacuuuguaaguaaaauuuaugaaauguuuaaugcaaaagugagcuguuauuucaaaaguuucccauaccacuuaguaguggguuugagugggcacagaggagcucugucaugugcaguuggccaggggugggaaggaagcagggcacaguggaguugaggguaaaauaggguuuaguacacauuaaacuauuauguagaaaaaugauuuuuaaauacugaauuggauauucucauuauuaaaacagguuuaagcuaaauauacauguagauauaauuuaaauguucgguauuuauguuaaucuauucauaaguaaaauuauugaaguaccucucauguuuaugcuuccugcuuuguaagauaaucugaaguaugauggaaacccuucguuuuagcauacuuauuuuauagugguugaaaacuaaagcagacuggguguggugucauaccccuggaauccgaggcugaggugggaagacagccucaagugugaguucagccugggcuucauagugaguaccagguucuccagagcuacagagcaaaaccucggcuuaaaaaagagauuaaagcagaaaaugaaagcaaauuuacuuuuugcuuuuugagaugggucuugcugaggcgcccuagguugagaacacugcacgacaggcugcccguacagcauacauacagcccccacccccuaguggcggcugugugcuagaccagcagacuuuacugugaaguacaaguguagcucauuguaugucccaggccuucccucgcugaugcugccccauggucagacagagcagugugagucaccccgucuuuauguuugcuucuagggaaugucccuggcuuuauccaaaauaguuagcccaguacguauuugcuuacguuagacaccagggccuuacuaccagagauuacuuacuggaguauuugaccucagcugaaaagcuaggguguccuuaggagauguggcauaugucaaaaccaucaacuuuaacuguacauuucccaguugcuuuuaucuugucaaaguuuuucauauuucuggcauucuuccuuaaaccauugagugaccauggaaacaugccugaaaacauggaggagguaaaaaucuagcccuuagaaaccaaaaaacaaauagcuaauauaagaaagggaaacuccagagugaccaggugcucuuucuccuaauagauugaugggcggccaccauggauggagggacaguugacaaaucagcuagucuacaguagaagcaaauucacuaguuuuaaaaaaaaaaauuccuacuggaaauccuggcuuuccuucuuuucacagauuuuucuuacucuugcauccuuugagugaucucgcuguaaacguguguugucugacaccuuucugagguuguuggugguuggcagaacuaguaaauuucaagcccuguacacaguagcugcaugcugacuugagagcuagucuguaguguugucuguugcaccuugcucugcuucguccggauaauuauguuuggaggagaagugcuggagucuaaacugguggcguuaauacugcuauuuguaaacuuguaacgugauucaaccgugaucaauggccuuguaguuuuggggaaacauaauaugaaacaaccaucgaugcuuaauugugggguagaugucuguuuucuuugcaugcaucaggaaagugcagcuacaauggagcuuuacaacguggggcuggcgaagcaugcagaggggagggaggcaggggggcauuuuguuuccuuccaaauuuguccccauuuugcauuuuucuauaaauucaagaaaucauaucccuuuuucauggcaaaagacaucaauaauuaaaucuaaauaaaguguaggggaaaaucaucuauauuuuaguaauuguguucauuagaaaggcuugcaacugccugcuacugaguaauauagcauuuauuauuuuuuuuuaaaaguaaagaugcuuuuaaaauauggcuuaacucuuuugguaaagcauauuauacaucauuuucacaagcacagaucuuuuugccucuagaaagggaaguugcauuuucauuguuaguguuuaaaccgacucuucuuguuuuagauuuuaaaaugaucuaauuuaaaguuaaagcugcauuauguuuggccugcagaggagggaagagcagauggugcucugggaucaguuucuuuuugguuauggaaaaggcuuccaucucaauacaacauuauugucacacaugaagagcagagucaccucccucggcaagggaacuguaaacuuggagucuucacuuuaaaacacacagguuuacauuauugccucauuuucuuugucuaaaucuuuaaucuguggaaauucaggccuuucaauuuuugaguuugcaaaaguaacagcaucucccuauaacguccggacccucuaaccugcuguccugagaaaggaaucuacagugcuuugauggccuuuugucaaauugaaauaauucuguaucacaauuaaaaauuaugccgggcagugguggcgcacgccuuuaaucccagcacuugggaggcaggggccggcagauuucugaguucgaggccagccuggucuacagagugaguucuaggacagccaagggaacacagagaaacucugucucaaaaaaccaaaaaaaaaaaaaaacaaaaaccaaauggaaguggaagacaaguaaaaaaauguuuccauggaccccuccucugugcuaacaggacaggaugcagcuuuaauagacuagaucuaaccauaacgucagucaacuccaucccaugcuucuuggccucuuguuaugauuaaugccuguuagcuggugacuugugugacuaaucaggaggcuuuuggaauacuguauguaaucucugccuacagcacaagcagcgcugcccugugcuggaggaccaguugguggaccuggugguguacgccauggagaggucagagaccgaggagaaguuugacgaugggggaaccagccagcuccuguggcagcaccuuuccagccagcucauuuucuuugugcuuuuccaguuugccaguuucccacauaugguccucucucuccaccagaagguaugaccaaagggcgccuccucagagccaauccugcugcuccuuaguguggcuuaguuggcuuugagcacucccggcuccuggcuuccgagggggcagaaggcagaucccuaauguugcuuuuguuuaguuuuguuuguuuguuuguuuguuuguuuguuuuaaggcagggucucacauguugucugacuugucuagaauucacuguuuagaccaggcuagccucaagcuuauagagacccaacugccucuagcucccaaggacuaggauuaaaggugugugccucuguacaugguuucuguagagccuuuaugguuuuuuaacauuuuacuuucugacuauaaacucuaguuugucacucauucuacauauacccacaaugccaggacacaugauacaaaaugaaaagacacuguaguaccacuaaggagucuuccacuagaggggaauguacacgcacacacacacucacucucucuggcucucucucucucccccccucauccauugcugugauaaaacaccaugcaccaugagcaaaagcagucugggaaggaaagggucgaucucaucuuacaguuacaguuuacagucuaccaugaagggaacucaaggcaggaaaccagaaccagagauggaugcagaggucauggaggaaugcagcuagcaggauggcuuucucagccugcuuucuuacccagcccaggaccauuugcccagggugcugcccacaucagucauuaacuaagacaauaucccucagagguaccuacaggcugggcucaugaaggcacuuugucacuugaaauuccaucuucccagaugaauguggcuugugucaggugaccagaaacccagccagcacaccauggaggcagguuucccacagaaugaguaaaaagggcguagacgcuaaaugaagacauagaacuaagcuuuaucaaagagaugcuuaaugcuucaacaauaaauagacguuucccaagaggaaaacauagcaaaguacuuugcuaacaguaguauuaauauuuggaaagauacaaaguugaaugaaaacugggaagaaaaauagauucaggaugauaugaggaagcuggguaagcaaagucaggcacggacaacuucauguggcuacaggagcuuagauuuucuuuugacagcagugaagagacagaaaaauaagcagaauggaaaaacugcagcuauugucaacauggaguaacuuugcaguauagagauaggugggcgugaccaaaacaguaggaaaacaaaacagcuagacgaaggcugcugauggcauguuccaacagugcaggaagagccagagacuagagagauagacugacuggcagguagcagaaggcuuagcaggaagcugccuccauugcuggcucacugguuucuacuuggugaugagcaggacaggacagcgaguucaauaaagggaaaacaagugggacaguaagugugggguaagcuggugucagcugugaggccuuaggcacaucaaguggguguggccaaguguuacacccauaacaucacacuagcguggaucccuuuacacgcacgcaugcacgcacguugcuuaaguaagucugcuuugaugauuucauacucacauauaguguauucuauuuguucucagccccaacgcccucccucuuguaguaaaccagagucuguaugugugugugugcaugugugugcacgcacgucauuuuuuuccaauggcugugucagaagaaagggaauuauagcauagcucggaggugcagagacgucuaccuuuccugguuggaaugagugaaguuuuucucugcagguaggagguagaccugccugccugggcuugagagaagcaggcaccaggcugggagguccaccaggcugggagguccaggagccucuugccuacagaguauugggcuugauucucauguuuaauuuuuuucuuuuuuuuuuuuuuuggauauguguaguuuaaaggagcacggaaaaacauaauguagccuggugugcauuuuaugcccugcauggagacucaguaguuacugaacacccaagcuaagauacugacuuccaagcacacacaccaagugugucagucccuguuguagaccagugagugugacgauggaagcuaaggagcucaugaggaagugaggaaggaaggcuugcauaccagcgaggcuuguuugccguuuuugacuuuucuaucccuggucuuucagccaaguugcuuuugagcuugcgguaagacagacagagcaucauggugaggggaugugugaaugagggugcuuguuaccucaucacagccaggaagccuccucagcacuccaccccaucuugcaucaucaccauuaggugauggccagacugaguauaugagccuuuguagaucauuugagauccagacuagaacaugaaggcgcucuguuaaaaaugacccgcaccuuucuacacguguuguuaguugcugaguguacauuugugcucuaacauuucuuacaguuagcagggcgaggacugauuaaagggcgagaccaucugaugugggugcugcugcaguucauuucuggaaguauucagaaaaaugcccucgcugacuuccucccugucaugaagcucuuugaccugcuguacccggagaaggagguaaguguccccgaguccuuagcagagcccuggagcuuguccagugugugugcaagaggacuggaucaccgugugugcccucucaugcuaguccauggcucgcucugaucaguggucugggcauucagucucuuuugucguugguuuucuugugugugaaaucaagaaauugaaccagguuguuucuagcaucugucugaggucacaauuugaguauuuguggaaaacucuucuuguguguucuaaguagcuguauagcuuuaaaaugucauaaugcccuugaucuguacgugucaccgaguggucacguaauaaguguguguuagugcauagguuuuguuuguugacugggucucauggugcuccaacccaguuuucuguuauauaacaugguugagaaaagcauaauuuauuuugaugguuaccauuuucuacaagaaccacuuuauggaaaaguugcuuuuuugggguuuuuuuuuuuuuuuuuuuggcuuuucgagacaggguuucucugcagcccuggcuguccuggaacucacucugaagaccaggcuggccucgaacucagagauccaccagccucugccucccaagugcugggauuaaaggcaugagccaucaugcccggaacccaggagugugaauagaacacuaaccacuccugucccugccaccaggacacucuuguuucaugcugcauuguucuuuauuauuuuuuguugucauuuuuaaugcuggauaauuguaguuuuaaaguagauuccagcuaucuauaguucauaauucucauauuuuccuaguguuucugucuucaagauuuuauuuuacuuuuaaaguuaaaucacaguguguacauuagguggaccacauuaacaugcccaguuguguuuuuauuugaguguuaaaaguugaaauacauuugugagaauuacagaauuuaucacaauuuguuacgcuuuuggaauauguucaauuuuucaaaauuaaacuuuaaacaacuuuuguucauuaguucugugauagggaaaccuugguuaagcgucuuucauuuuguuaagaaguagaaacuugccaacaagaaccucuuuuugaaacuuuuaugcuguaaggccucucguaauguugacuggucaaagagcuauuggggcuaagcuaagauaggaguucuaacgcgcuacaccguaaaggauuucugagcugcgcaugacuauuugauccucauucauauggcagcuaacuacucuuuuccaguguaucccaguuccugauauuaacaaaccccagucaacgcacgccuuugcaaugacuuguauuuggauucaucuuaauagaaaagcucaaaauggcgacuccacgcuccagaucccaauaccccauucccugaagcugcaccaugaguaaguuauuuguuauguggagcuuaacugucuuguugcguuaauaguggcuuguagacugguauugaucuuaguauuugcgugguguuugaugucucccacacggcccaguaggcugauaguuaacccugauaguuaauauauauguuacaguaaggaacuggccaauggcaacgucagaaaacaacuugaccgagccuucucaugugcuuggguaucuuucuacacauuuucaagacuaguucugguuuuuauguguuacacuuuuaaauuacaacuuaagguaucuuaucucuuaccgacgugagacuauuucaggguuucccaagugcuggugauuuggacaugaucuaauuuaggcaucuuucacucccugggauggccagaagagagggagccgauguggcuggcaggcaccuucugugugucccaaagcugugaugacgcagagaugaugccccuuagagagaacugcucuucagucaugguguuaggaaguagcugggcuuccuuucugggacuaucagaucucuucauagagccuguccguggugagggccauguugggggcuuuuauuuuaugaaauaccuguaaucaucuuuucauugagaaaccaauuaugaaggcauuuguuauuuaagcagauaauaaauagaaaucuuuuucauuaauuugugaguuauuucuucauucuauggaacuuagccuaaaauagugugcauuguguauaguguauaauacacacuugacaaauauccaguggcuguuaacuuaggaugaagcgccaucugcaauauuacccaagcuuuaauagguacagccacuguauauuucaucagaaacuguagugucuguaagaauaaacauaguacuagcaacugcauaugauugaaauuacuaaacugcaauuaacuucauggguaucauuugaguuuuucuguugaaauguuacagguuccuccagcagagucugagaaauaaaagcuuacagaugaaugacuauaagauugcccugcuauguaacgcguauuccacaaacucagaguguuuuacguuaccuaugggagcucugguagaaacuauuuauggaaauggaauuaugagagugccucucccuggaacgagcuguuuggccucagcaucagugacucccuuaccgaugaaccuccuggauucacugacggugcaugccaagaugaggugugugcuuauucucuaucugggaauugauuuaaagaaaucugguaauuuuuuuguaauuacagguaugugcguguacauguguguauggucugugcauuuaagaaugauuuccucacgugcucgcuucggcagcacauauacuaaaauugggacaauacagagaagauuagcguggccccugcgcaaggaugacacgcaaauucgugaagcguuccauauuuuuguaccgaaggagcugaaggggucugcaacccuauagguggaacaacaauaugaacuaaccaguaccccggagcucuugacucuagcugcauauguaucagaagauggccuagucggccaucacugggaagagaggcccaucagacuugcaaacuuuauaugccccaguacaggggaaccccagggccaagaagugggaguggguggguaggggagcagggcggggggaggggauagggaacuuucgggauagcauuugaaauguaaauaaagaaaauaucuaaaaaaaaaaugauuucuucaaaaaauugaauguuguuaacuauagaaacuauagacuauguagaggaguguaaggcagauggugacuuuauccuuuucacaagaaaauggaaaaucauuuuugcaucuuuuuuuucaaugaguaaauuuaugauuuuauauauuguggagaaaagugugcuauuguaucucgguuuucuccuguaauaaacaucuuuucaugugguuuuucauccagaacaguuuuggauugcuacaacaaaguuucuuaugaagccugaguggccacucuauguugcugggugucgaggguuugguggcuccuauguaguagggagauguugaugaagguuuccuucacagcagucacuguggcgucuguaguugaguuugacugugucuuuuucuuagaguuuuuacuaaacagcuuucugaaaggagaauugcuguguccuggaauuuaagauguuauugaauuacacacugggacacuuuuagaguuguguuuguuuccuggaaggcagaaaagcuuguguuggcacuagaccuccagugcccaggguagccaggcuggagcuguagugaggccuggcacagcaugcugagaagugggugucaguucacacggaggccggcguguggaggcgcgugggacagcaguagggucucaucuugggcugacaguucccucggcguggggaguggaacgcugccugguaacgcugcucacagucaguccucgagaaggacugugcucucaaguuuuaaguacugacgcagaguuaagacagcacugugauuaggccagauacagugucagcccugcaaaagcugugcuuuuuccucucagaugguacccauugugacagacugugugcuacuucacuuguauaugugacaaauuugagcaaagcccugcuagaagcgaacaugugggucuuagcgauaauuuauuaaauaauuuugugcuaaauguuuugugaugaaugugguaaauguugcuccucuaagguacuucuuacuguuugagaggagaagcuggcuaaaagcccucagucaugcuccuauuuaugguuuauauggagagcuugcuuugcccugagcaggaucccuguguguauuccagcuacuacacccccagcccuaaaguccuguggaaaccgcaguuuguuuccaguuguccagaugccacuaccaagagucugauacagcuuaagcuuguuaagugagccagguccacuggaacuauugcauuucagguuccuacgucucugccucugagaagaacaacuguguucauagacacggguucucauuuucuucuucuuuccucgucagccuuauucacagcauugcaaccagagugauaaaacuggcucauacgaaauccaguguugcgcuggcuccagcccuaguggaaacuuacagccguuuacuggucuacauggaaauugagucuuugggcaucaaaggauuuaucaguaagagaaacuuugcugcuguuucuaaugauuaacaagucaguaugagaaugaagcagggagcaagugucugacgugaggccagccugcugagacaggacagggaugaagcaggcaacgacagaugcaugcuuuggggcagagaugggugcugugggagucaaagggcagaacaggccucccuuagugucugaggugggagggagcauggcaagaaauaugcugcucauaagccccaaguaggacugggccucuccugcacauucguucuuagaugaagcacugcugccgccaugaggcgaggcggggcaaggugaggcugaguguggccaugggaaggaguugucauccagugcagcgacagcguguuuaguguuuagcaguucugaauaauagguacucuccgacugcaggcacuuuucugauucauuucaccugcaguaugaguuuuaaccauaguaacuuuuucccagaagugaacccagcuuucuuuuggauggaagaaagaaugaacaaggaaagacauuagguuuuuuguuuuggucuagguuuugacuuuuuugagauagugucuccuguuguccaggcuaggcuggccucccgacuccuuauguaagugagucuggcucugaacucuugccucuugccucugcuucccgagugcuggaauugugugcccccauggcuggcuugucuugucuuagcuuucuuccuuucccucccucccucccuucuccuucccucccucccuuccuuccuuccuucuuuccuuuuuuucuuucuuugguguuacaaaagugauucuguuugaauuacacuaguugcaaugguguacaccugaagucucagcugaggaaguucacugccagucuggguaauggagcccuuggcuucaauugccagcaguauuaaaacacacacacacacacacacacacacacacacacacauggaaaugaaucucauacucagaagugggaaaccuugacucuauaaaaauacccaaaagguaacugugaugugcggcagaccagaagggcucuuuugguuuugguugguugguuuuuguuuuauuuuugugugguugcuuucauuuuauuuuuccauauuaaccugaggcuggcaugucaaacucuagaaaggaaagauaaacucagaguguauuuaggcucuggauuuuuuaccccuacaauuguaguggaaauauguaaauacuuguguguguguguguaugucuguguuuauagucauuuucacauacauccugagcgacauucuucugauauauacagggauguccuuuugcuaacuggucccuggaauucugcccugguaggucagcuccugcccacugucuucaagucccacgccuggggcauccugcacacacugcuggagauguucagccaccgaaugcaccacauucagccccacuaccgaguucagcuccugagccaucuccacacacuggcugcagucgcacagaccaaccagaaccagcuccaucuguggugagugagcagccugcaggcugccuccccuaggguuuaguccacccaugcuuggaagugggggucuuaaucccccugcccccagguccuuuuuuuuucuuauuugcuguaaaauuaaaauucugcuuauaagacaaaagagugaaacccaaguuuuuaaaagaauuuggauuuacauguuucaagucaugauuaaaguaccauuuuauggaaggcagagacaaacagaucuaucugugaauucaaggccagccuggucuacacaaugagcuccagaacaaccagggcagagaaaccauguuuugaauaccaaaaaaagguaucauuucaauuuugauuuaagugaaaacauauuucggauggaaaucuguaacuuaauggaggaggggacacagucucguguagcauaagcggaccuugaauucauuuuuguagccaacacaagaucuaaaaucugauccccgugccucugccuccuaaaugcugauucucuuagaguuguauucugugaagagagacaccaugaccauggcagcucuuauaagggaaaagcauugaauuggggcuggcuuacagcuccgaguuucaguccauuaucaucaugaagggaagcaugguggcaugcaggcagacauggugcugaagaaggagcugagaguccagcuucugaggccucaaagcccaccucuuaaucacaucucucuuccagggaagccaccuggacuccagguccccaccuccuaacagugccacucccuaugcaccuauggaggccaucuuuauucaaaccacugugcugacugcgcaggugugugcugccuaccuaguagugaggugccaucucucuaggagaaggguuuucuucuagucuauguguacaaggucagcuguuuugcauuguaaaauuuagcaucaaaaagggaagguuauuucuaugaacgaguauaaaugaaugaagcauaaagaauguaaucuuugugcuaucacauguucacaacucugcaauugggucugccgacauacaugugaacugugcguuccugcuuucaguguggagagcacugcacugaggcucaucacagcccugggaagcucagagguccagccgcaguucacgcguuuccucaaugaucccaaaacagugcuguccgccgaaucugaagagcugaaccgagccuugauccugaccuuagccagagcaacccacgucacagguagagauccugcaagggauguuagcauacacugugcagcuccucucacaccgugagagcacaugcgagggaggugccuuucaggaaagcaagcccguggcucuggucucuccucagaaucggcuaaaggcgggaggagcucauggcacugccauucuaaggaaauucccaaagguuuucuuuuuauggauuuccaucuguauauaaauaagaauauuaguaauuaaaauagagaaguuuaaaaagaacuuauucauuuaaaaauacuguagcauguaaccuuagcguaaguaacauguaaaaaguaguuucuauagcacaacucugacaggaggggaguggagccuuuguuuuaguuuauuguuuaaugguuguccuuuaaugucugcguaagcaaacguagguuuucauagguggucugucucacagcaucuaucugcuucaguguaugaugcuggggugguuagagcacaugaggagagcauggcguuucagacgccucaggcuuuucagauaacugcguguccucugucuguuuuugaaaguuccuucaagaugagcuguaugugaaacccuggcccugcccauggacuuucgcacuuugcugccccaugguccgcuggccuauuuuuuagauugaguacauuuuuaauguaugugucuuuuaucaguucguccuuuggaaaacauucccuguagcaaaugugaacacaccuuauuauaauuccauaacauuguguguguugauaccacuauaaauuuuguaagaauaucuuuacaucugggaaaacacucacacucguggacaggagccuuuccaguuucuaauuuccaccugaaacaucagccucagcaucuggagaagacgcuguccuucugucuuucguuucucuuaaaacaacagggugaauuaauuuuugagagagugucugccagauguuuacaucugcauaauuacuggcuuuucugucagauauucuucuaccuaaaauugaaauucugugcagaaaggcagcuguugcaccugaguccugucauuucccucacacuccuugcacuguggcacaccaugcacauuccacacacagugggagugggucuguaugugcucauuuguacagcaucauugacaguauuuucauucauuuuuaauugacacauaaaaagaaucuuacuauuuaugggauaucacaugauauuuccacacauauguguacauugaguaauguccaaggcaagguaauuuaccugcuuaaaauuuuucuucuguuuguaguaacauucaaagucccuccugauaacuuuaauauuuuuaauuuauaggacauuagccgugaucuuaacugagacggguaccuuuuguccuuguugaaaucaggugguguauaauaguguagucuggugccuucuuugaagugugcagagagccaggcauuucacuguaccauugagaaaugcuaaggauagccgagaauuauuaucugaguaucucugaacacaucaaauucuugaaaagacaguaggacuagcuauagcagcaaaggcuuguaaucuuagcacauggagaguuugaggcaggaggauugcacaguugagguaaaccuagacuuuauugcaaaaccuuaucucaaaaaaugaaaagaaggauggaaaggacaccugcaacugcuagaaaccaucagaccacacuuugagagguguuuguuuaagaaaggaaagggaagauaccagauuuaccaguuccagcuacggcguuguaaacuguuauuuccuguaaguaaacaucuggauuuagagauuugcauuugacagggcguguguaguccgacaucugcuuuuucaguuccauucccuuggcccaggaaagacuauuaaaaauaaaaaggacucuaaaguccuuuguugucucuucacuaauggugcuccuauuuucucacaaaaaguccuggucacuccuaguuauucuccaaguaagagguguagauccuaaguacaauguagguccccagagagcgagcguccugcacugagacaucucagugagacaucucagggugcuuuggcuugcuuugacaguacguaguuugggucauggagaucugacuccugucuguuuguuuagauuuuuuuacaggaucugauucaauacagggaacuugguguaaagauauccuucagaccaucaugaacuuuacuccucauaacugggcuucacauacccuuagcuguuuuccagccccucugcagguaauuugguucggaauuacguauuaaauacaugguaaucucuucuuccagucacuguggcuuucuagggagugcuugaccugguaauagcugaagaaaauuggcuguuuccuuuuugaaaauucuucuucuuacuuccaaagucucuugaauuccuucccauccucucgaggauuaaaugugcuccugagaaagcaauugugauggcuucaguuucuaaaugaacaccuuuagaaucucacaggaguuagcacaacaccugaaaacuuguguccuaacacuaagacggaggagaauaagcuucagugaaaccccuuagagcauaaaggagcuacguuugacuguguugauuuuuuuuaacuguacaacagaauuauaacuguggcugcauaaggaggaggaaggcaaaccugguaugucugucugcucagagaagcucagagaaguccacagcacgguggacuugagugaagcuaaagugucgcuugucacagaucacagauucuggaucccagccucagagcugcuggcugagcagaucugggcagggccugaagacuggcugagcgugcgccucagggaccagaauccgagccacuggccugccauagccgauucuccuuguggagacacugcauauauaaccuauguaaccucacacuucuuuuccuuccucucuuccuucucucaaagauuagcauaaaaugauugaagagacuuugaauuuaaacuugcuuagaauuucuguuuaggacuuagaaaaaaggaacuuagaguugcuaggccagccuguaacguucaggcuuucuuucuuucuuuuuuuuuaauauuuauuuauuuauuuauuauauguaagcacacuguagcuaucuucagacacuccagaagagggcaucagauuuuuguuacagaugguugugagccaccaugugguugcugggauuugaacucaggaccuuuggaagagcagucggcgcucuuaaccacucagccaucucgccagcccacauucaggcuuucauuacugccugacucaaggacacuuaguuuuauaagacacauaaacacagaaggagguauuuguucugccagaaccaaaugcacaccaaguuccucgccuccgauuguccaguguuccuuuuuucuguauccagugacaugaacuucgaaucuuccuuuuaggcuuucuucaagcaaaauaacgugccccaggaaagccguuuuaaucugaagaagaauguggaagaagaguacaggaaguggaagucaaugacugaugaaaacgagaucaucacccaguucucugugcagggcuucccuccacucuuccucugucuccucuggaagaugcuccuggagacggaucauauuagucagaucggcuacaaguaagccagaagccccggguuucagucugcuuggcagucagcguuguccaugccagagcucaguucucacucuuugccuuguaggguccuggagaggauuggggccagggcccugguggcccaugugagaacauuugcagauuuccugguguaugaguucucuacgucagcaggaggucagcaacucaauaagugcauugaaauucucaacgacaugguguggaaguacaacauugucacgcuggacagacucauucucugccugguaagaauacguuucuaagccuuuuuaccaugcagugaugggauugugugagugggaggccgcgugcugacuuccucuguuuggccucagagaauuucaccgacuuaugcugugcuuaagcuuccuuaaagaagaaggacuuucuggauucccuuuuucagugcauuuucagugauuaguauuauauucacagaagauacaaaaguaaauagauuuuucuggucuuguuaugcuuugaaauacaaaugguuuauucucagaggcugcaggucaggaaauagugaaaagcuauugcuugucuuugcuagcugauguaaucauucccuucagucgucaggagucugacuguuguguguacccagcauccuccacguguucccuuggcuucugccuguuaguguaucucaaagguagcugguucgucuguucgucuguuuguuuuaggguuuguuuuguuuucaugugcaugaguguuuugcuugcacgugacguugacagugugucugggggccagcagagggugucagaccaucuagaacuugagauacagagaguucugaggagcccugucgugcugagaaucaaacccacaucaccugcaagagcagccagcgcuccagacucugagccugcaaacacuucaacccuucaagccaaguuuuacgaaaagacugaauuacacuaggaaauuaaauacuuuuaaaaaauuauuaguguuuggguauguuggcauaucccuguaaucccagcagaugcagggggauuguccuaaguucaaggccaggcugguccacauugagagcccaaggccagccagggcauucugguuguacuuguagugacuucguucauuaauacugaccucuucucugugaagcauaaacguacagguaguuguaguguaguagggggacuaagacaguguaccuggcaaagguaaugcagugaugcggggaaagagcaucagaaaacaggccgucacgugacaucaucaaagaaagcuuuaccuuaagguaaacauuccuagcaggaggaguagugaaccacaaauaggccaaaagggucaaaucaucuuuaggagcgaugaaagauugguuugggguagacuagacaucuaaggaaauuguaauaauauaauuuuaugcagauacgacuaguucucuuaauuuuucuguuuauuuccaaaggcuaugcguagucaugaaggaaaugaagcccagguuuguuauuucauaauucaguugcuguugcucaaaccaaaugacuucagaaaccgaguaagugacuuugugaaggagaauuccccagagcacuggcuccagagugacuggcacaccaagcacaugagcuaccacaagguacccacucugagagagagcagcagcggggauggcuguucaauugauugggcuguuugcauugugggccugugguuuccuuuauggccucuguacagacccacagcgaguuagcuguaggcuaugcuaaugaauaagaguaaaauguaacuguacuucaagucggcaugauucugaaucaaaugaagauagcaguaauaaaauuaguauugcaugacuuuuggggagcugggguguugcugauuuaaggaggcaugugcuuuaaaaaauauuuuuuuguagauuucuucuuucucucucccuuccuuccuuccuucuuuccuuccuuccuuccuuucuuuuuuuuuuuuuuuuuuuuuuuuuuuuguagcucuuuugugcucgcuuuuuuggagcuacucuaacacaugucugucuccucaccuacagaaauaucccgagaagcuguauuuugaaggccuggcagagcagguugacccuccuguaccaauccaguccccuuaucugcccaucuacuuuggaaaugugugucuccgguuccuuccaguauuugauauaguaauccacagguuuuuagaguugcuuccaguguccaaaucacuagagacucuccuggaucaccuagggggcuuauauaaauuccauggugaguuuguucagcuuguaauuccaucugacaccuuuaugaacagauaggcugagcacgccauguaguaaaagugguucugcagguuugaagcacugcagggugaagucauacaggugucacaagaugcacagcacagagccaugagguuucucuauaaagaaagugggugucaggaggucugggaggugcaguuugaacuuuugcuaugcacaguuuguaugagcaggagggccguaagcauacaugagucauggggucuuuugggaaaacugcggugguggaagauaaaggccuauuugaaggaagauggcuuuauugaacugaauuaagaauguuuaccugugaguuuuaaaauaaggccaggaaaggaaaacacgccugacugcaggcucacauuaaaugccaguuucaguuuuauaaccuaaagauggugguucuggaagucacggaguaagaugggugggugggagucauuguuuuagaaugaugagguuagguguggcucacagcccaucucagaacuacaccacagccucucaaaaagccgugggccaugcaguggauacaccggaaccaggaacacgauuuugcugggcuguguuuacuuagaagaccauugaaacucuggucuuaagacuggaaacuagagcaugauacagcccaugacaaaaaugugaaagcagaaguauauuacugaacagaguaagugucaggcucaagggagaauggaugccuuuaaaaguagugcucuggauuaggugacaugggaacacugucuccaaugggugugcagugacaagucccacugugugugcagcuggccauagugucugagccggcacuaugacaguugucugggugaccuuccuuagaugccacugugacaguugccuggguggccgucaggugccacucuggguucucacucuuugccuucuuuuguuugguuaaaaauacauugcagcauucugcaccugguucuuucucccaucugcugugcugagguugguuauuaacgucaguaugugaagaccucuaccucucugugauaauuucucagcccuuuguuugugacuguacuugacauuugcugcuuuccaucguuuuugugcaguaaauguacagaaguaaaagugucugcucaggacaaccacaaauuauguguguuguuaggaaucuucugccugauuuaggauuaaagugcucccugugugugaugguccagcgugugaaguaaugucaguucucugagcuguguuuagguagucauggaagcacgggauucgcuuucauacuuaucaguaaccugauaaacacgcugagcuguuuucuucuugacagaccggccagugacuuaucuguauaauacuuugcacuauuaugaaaugugccugagaaaccgugaccaucucaaacgaaaacuuguccaugcaaucauuggcucccucaaagauaaccggccacagggcuggugucucagugauaccuaccugaagcaugcuaugaaugcacgggaggacaaccccuggguuccggaggacuccuacuacugcaagcugauuggccgacugguagacaauauccuuucuucugucauguuucuuccagacucuccauaaauagcaguauuuuagcuuguaagagcgguuuuuaagguaauguucuuuguauuucaaaaccucauuuuuaauuuugaguugcuuaggccaaccuuagccucauugccuuggacaguccucugccucagcuccucaggaacugaggcugugagcgcaugcuauacucacccucaggccuccaguggcaggcuaacuguggagucauaacuggcccagaacuugcuguauaggccaggcuggccuuagacucacagaucuuccucccauaugaugggauuaaaaguggccuuuaugauuauuuuaucuguguaaaaguuuugaaacuuuaaauugcaucaucauaccagacguauaggaguuuucucuguugcgacucaaauuuuuuguuuguuuguuuguuucgagacaggguuucucuguguguagcccuggcuguccugaaacucacucuguagaccaggcuggccucaaaacucagaaaucugccugccucugccucccaaaugcugggauuaaaggugugugccacuacugcccggcuagcuuuugcuuuuuauuuuuuauguauguuuuuauuucuugaguuugauuucauguguacaguuaucagcagucuacauaacaugucuguauaccaugccuaaauaaaagaauguauuuccugugguagcagacuuacucauuuuuaaagaaauguuuacaugaaauugcccugcgacuauaaaagaaaucggauaaagaggccugaggccacauuguucugucuccuccugguauagcaucuguucugagaguccauguguaaguacaaccacuuguuucguggguauugcucagugugcuuaagucacgcaacacuuaucucaugauagcuuaucucauguuugcuuuguauuuauuguuuauccuuuuauauuuuaauuucaguuaaaucacuucuugacagccuauaaucagaucaguugauaaucaaaugagaugcuuaugucuggaacuuuaugaaaccuguaaacacuguauuauguaagugugaaccauucaucuuagaauagucaaauuguuauugccuuaaucuuuugcacccauggcgggcaagucuccaggacccuucccaaacugugacuggagauucaaugaguuucccaaccccgcugcccacgcucugcaugugacguguguggaacucauggccuuggcgguuccaggcaaagauguggggaaugcccuucucaaugucguccugaaaaggucuguguccuuuguccuggaguuggagucuguuuacuucugccgggguugcugucaggcagaccugugccccaaagugagcgcuguggguaacagucuucucgucccacucucacugcugaggugcagggauaagagaaugaccaguggucacauucacuagaccaagguuugcucacauucuaccucuaaccugcuugaugaugaagugagucauaauguuagcuugucacuguaagucucuguacagaugagcaggagcagggguagagcuuguuagagcgucuccucagcaagugcuagauagaggguaaguccccaggugcauccuccacuccaaacauguccucuuaaaagaucagcagaaaguagggagcagguauaaaguccaaucguuuuucagccuuaagacuguuguuaaaggacacgcaaacaaaggauuuauuuuguguauauuuuuuuucucaaaaaaaauaacauuauuauuuggaguugauuggugagucauccauacaaaacaagauccuuagucaaguguagagaauguuuucaaaaugucaccuuuuuuuuuuccuguccucuugcagccagcccuuagugccaagggagaacauuacagcguggaugaaugcaauuggucugaucaucacggcccucccagugaguugcuaacuguggguuguacguaaugaugcagugucaaccagagaaaugcauacagaguaagcuugcccaggaagcucaugccaguuaaugaaccggcuccuucuucagucuuucauaccauugcuuuuuaaaaaguuccagcgaggcuggagaugcagcucagucaguagagugccugcuagcgugcgcagagcccuggcugugagugcacagaacacacccauaaucccagcccuugggagguagcgacaggaagauugaagcuucuaauucgucuucagcuacaucaccaguuugagacuagccugggcuucaugagaccgugucaacacauacacauaguuacagucacugucacuguccuuuugcuguucccugucacuuaugaauguaucugcuagacauaucuaucucugccaguagcagcuuccccauccauucuucauuuccgucucauagucuggucugguuugggccaguaaacaugcuguccauugcacacacaagccagacaaguggaaaacuucaguggaugcaagagcagcggggcggcagauaggcuuugagguccauugcuggguacgugguaucuuuuuaagcagacuuuucugauuuaaaggagccguacuggauugugcuucaugaccgaauugugaaugugaucagcaguucuagccugacgucagagacagagugggucgguuacccguuccgccucuucgacuucaccgcuugucaccaguccuacucggagaugagcugcagcuauacguuagcucuagcccaugccguguggcaccacuccagcaucgggcagcucucgcuuaucccaaaguaagcaggguucccuaacgagauugggcaucccaguuccuaagucugacuuacaaggaaguggcucucacucaugaggacugcagagugcguuucagacagcgggggcccugguuagucagaagccucuuauuucagaauugcuuaauuucuuagguaugcaaauagugauagcucauuuuuccacuguacuuuugggaggcuuacucagaucucugccccagaguguaucacagaaauggccuuuugaacugaaaacuggacuucaucuauuugcacauuacuuuuguugacuguaaaaagcugucaauuagaucuaaauuucaugagaauggcauuuccguaaauucucuuuuccauuuagguaagucaccugucauuuaacaccuguacuuuauauaggaauuacuuuuaaguccgaaguaauuuauuucagugaucagucaguugaaaaugagaccaggugagauaugcaagaucuacaggguaccauuguuaccaggagagggagaugcuuggacagagagugugcugugcagauggacagagaaugugugccaucagacacaaagagagugugccucaaagauggacagagugugcuguguggacgugaagaccucaguucaaaucccaggagcgcacauagaaagucagacauggcugcaccucaccugcaaccucaguacuguggggaggaguggagacagucggauugcugggugccagcccggcuccagggccacuggacagguccuccgcacacacaggccugugugccagacaugcacacugcacccacauacauguacccagagggaaagaauauuguuaccaaagucacagguaaagcagcgcuucccgucuucuuacacacuugcgagcagugugcugacauucagaggauugggcggcucggacuucauguagguuuuaucucugacccucagguuucucacugaggcgcuucucccgguggugaagacugaguuccaguugcucuacguguaccaucuuguggggccauuucuacagagguuccaacaggagagaacccggugcaugauugagguaaggugucaucugccuuagugcaagucgcaaagagcuguuucucgacaaguguuuucggucagccggaaguuguaagguguguuuugugggggcugggauccacuugggggcuccgugugccugcagggaguuuaguguaugaugcgcugagcuugagacgcaggggaaaguagcugugcucaaggagguaggcaggguugugggcacagaagugugugugggaaauuacaguaagggggcuggaggaaggcaagcauuucuaagaaaaugggcaacaguagaacagggcuggagagaugacucagugguuaaaagcacuggcugcucuugccaaggaucuggacuuaguucccagcgacuacauggcaggucacaaucaccuauaauugcagcuucagggccuccagguuuucucuuguggcaucuugggaacugggcaugcacaugguccacacacacacagagaauaaacuagaagacaagucuuuauuucuguuaacuagcuagcagacggagcucggaggugcacuaaaccuaagcaccccuggagugaguuacugugaggugaugucuggaaggggaucuuguaucuuaccaagagagacuuggcuguggagagggauucuaguuaggccauugcauagcucugugaucccacucugagugcagacuguguccuaugugcauagcgaugcaugggcugugacugucccucugcacaagugccaucccgugucagugugggagacugggcagguuggguugaaugauuugaucauguagucacuuaaauaaccuuaucugcccgauagauuggcguggcauuuuaugacaugcuguugaauguagaccagugcagcacgcacuuaaauuacauggaccccaucugcgacuuccuguaucauaugaaguauauguuuacuggugacagugugaaagagcaaguaaguucgucuuuuuacuuuuuagugauguuuuaaccuagcaaacuuaauacauggugauaaacauuuuuguuugggguuuuuggcuuuguuuuguuuuguuuuguuuguaaagugucuaguaucuaaccucuuaaggccacaggagaacauaauucuagauacagugauaaagaaacgaucucuuagcuuucccugugguguuugaaacagaacaucagaaaacccccuaaggcaucagugaguaggcgccucuuugaauagucugcuccccugggaaagcuggugguauggcuaggaagaccucucagggaaggaggcucccccccccaccccauuggcuagggcacauuaugggauguugaacacacaguggugcaaguacaagucacgccaugcuacucaagaggcaggcuacugagaguuucugaagagcgugaggguucuuagccugaagaacagagucccaggaagauguccucaucgccacugcucagaagguuuucuucccaggcgucagauuuguucugucaugugacacagcaagccccguugcgaaacugaagggaugcacccuaaaucaggaagaggcauuuccuacuacaaguggcaggaagugggaagaccuuaguguguguugcauguguaggaagcugugagcuguucugggggugucaguaaggcacauggcugcagugagccucucuccucggugccuggccgcuguuuccucucugccagguuggauuucugucugaacagcacugaacagugggcuucauuguaacguuuccacacuggcgugugcucuuuaaccauauucaccgcuccaucauagaaacuuaauugcugugucagcauggauacuggcguauggagcugaugacaggaagaccaagcuccuucacaccuucacagcagugucagacuuaacacuuccccuccugaaagcuuuucuuuuuguuucuguuaccacacauaaaaaugggcagaacugaugaagauuuuuuuuuuaaaaagauuuauuuauuauauguauauggguacacuguaucugucuucagacacaccagaagagggcgucagaucucauuauagaugguugugagccaccaugugguugcugggauuugaacucaggaccuccagaagaguagucagugcucuuaaccgcugaucugucccuucaacccacugaugaagauuuuuaaacccaaaauguauucuuuguauuuggaccuaaacuuugacauaggaauaaaacaaaaagaaacguugcugacauuccaguccuuccccugagaucaaagagcauuagagcugagaaagccaggacgcuggugcgucugucuccuuaucguguucugagugcuggcccugcagacauuccugcugcucgggucuaacaguaugacgaguccaacuguaaaaucaagaagacagcuuuggggagaacuauugcaaaugcuuucugcuucugcuaacauugcauucagauuggcucagaaggaugaccaaguugguagauguccaucuccucaugggagcaauuguaguuguggauagcaggguagcuaagcagguagaugggucauaaguucuugaagugcauguguagacagagacaggcacguacacacagaauguauauacacaaugugugugggaguacacaugugcuugccuguguaagaaaagaauugugugccagcuccccacuguggcguacuguugacagcugaugucacuccguaaauguggacucugcuuuuccguaauugugcucucgcuucuuagguagagaagauuaucuguaauuuaaagccggcuuuaaagcuucgucuucgauucaucacgcacauuagcaagauggagccggcagugccaccccaggcccucaacagcgggucuccagcaccucagucuaaccaggugccagcaucucugccggugacucagugaagccagaggcacugugacugaugcagaggaguggacucacgucuaaaucugaacaccgugcuaguaaaacgagagcagccaccauguucagauugguuuauucugauucaaauacugaaucccucuccuugucuauguuuugucucuaagagauaaguaaguuacauguuguucauauucauaucacuuuauucaaaucccuaggaaugugggcguuucuauacucaaguggcuuuuacuaggcacucucagacuuccugucuuagccauuuuuaaauuauuguaaguaacaucuuuacaucuuguauaccuuaccuugaagaugcgacacaugugaaauggccauuacaaacccuuuuguacauaaauguccuuccaaauagagccuuuuuauuaauaaagggccuuguacuucacuuggaacaaaggacguuucauacucuugucuuugguuuuuuuuaauugccuauaaaauuuuuauuguaaauuuuaaauuuccaagugguuccaaguaagggaugccaaguuucuaccaacguagguuaugggaguuuugcuucgcucugagcucucuguaugaaaugaaaccaucagaaaguuagaaaugaaauaaagccgugcucagacgucuga

SEQ ID NO: 12454 - RNA, 27346 nt, Mus musculus
ugccgagugucgcgcgucggcgccgcugccuaucccgcucugugcccuacggcccucccggcacccgccgccgucccgcuccgggcugcccuugcuccgagggcugcagcaccggccguccccgucagcccucuugucuggccgccgggccgcggcgggcgggagcagccggaggaggagccgcagccgggaggcggcggccugagcccauggcguacagucaaggaggcggcaagaagaaagugugcuacuacuaugauggugaguggccgaggagccugcagccgggaugcggggagggcgcggcggggugucggggguggcagcccgcggggacaccaacacggccuacccagcgguggcgucucggggacgcccgccuucgcuccucucggguccucucgggcacacgcagguuuagggugcacugccucugaccggucucccgaggaaccccaguuggcacccugggccugacugcacaaagcuggcguccuggagcuccgccccacgucccuguccccucccccgcucucccgguccccccuucucgcccccgaucuguccgcgcugcgcuuccagccucacccgggaccccggcacccggguggggcugcggaggaguuacugcuggccgguggccaaguucgcagagcggcgcugucucgcugguguuuugcguggacuacaucccucgccuuuguucgcguucuucgagcuccacuuucucaggguucaaauggaagggcugcacuuccucggugacaauuaagggguuuugaguuggaaguagguaggucguugggaagugguaggagagaggaagcgugcaguuguucuuguuugauggguccuggcaugucucuaugggagguuauuaccucccccuucuuuguugcucuuuguucgaucugcuauaauacccugcucugggggguuaggaaagaacaccggcaucuugcuuaggaacucuucuacuguggugaagaccuugcugcaggaaacuuugagaaguggacuaaauauucacaaugcagugaacgguacaaggugacuguaaggauuuucuaauuuggaguauaaguaguaauagucucuggguucaguuacaccaaauggaauggugcccugccuauacagauuucacccaagacaucaauagauaaaccauugagagaaguaauaaggaaauuugacagaacuuucgaagcucauugauugaacgcuugaucuccacaaagcaauaugaaauugggagcguuuucuguaguuguauugaagucacaguguuuggagagguagauuagagaacuaggcugaaugaaacacuuaaacuuguuaaaauagucgugcauuuucuugguuugacagaaucuuuuaauacaagcuuuaaauaaaauagccaccugucauuggcuggaaaaccaaaaaccuuacagaaagcuaggccaaaauggaaaaggcuguuuuguuuuuugagacaggcucuaaguugaccuggcuguccugaaacucacuguguaaaugaggcucuaacucauagagauccaccugccucugccucccagauccugggauuaaagauaugugccaccauggccuggcuuaauuggaaguuugagaggacucaaacuguauugcauguuuauuugaaguuacaccaucauggagagcagagaugggagagcaugucgguuuaaacaugaguuacauuaugacguuggggucauagcaaagcccugaccugcauucucugauccauuggaaauuacagccuuucuaaaguaaaguccugcucuuguuagagucaggggaaagguugagcuguuggggaacagcucagucucuucagcugucagcuucugucaucagugaugaacucuaagucccauuaacuuucaccaggccugauggagaaccagagaggacucucugucuugaacagcuccuuccuggcuucaugcguagggaugagccuuugcugaggagugggauagacauuggucauggagauaagguguggagggaggcauuuuucagucaugugauuuucgacuuaugcccaugcagcugcuuuaccuaguugugagugaccaacuguauaauugaugguggaaaucugcugaguuaucuaucugugguucuuacuugacuuguuuuuagaauguacuuaacuuauuuuuauucugacuauuugcauuugggggacgcuaacaaaaauugaagauauauaaauuggugucauaguuaagcuaauuaacaugucauagcaugcuagacuacagagaauucucugcagagaauucccuucacgucugacuugauuacagaaacccucuucuuguuaguuuauaaagguagcagcaaucuuuaauugucuuuauuaaauucuaaacaagaggagcaaguaaagugacuuuuguaccaagaaagugcaugacuuucagacgcaugcaggguuggguugguggagaacccggccaguaggauuggggcucgaauaguauacuagucuuauguuagugcuuuuaacuugguugguaggggaggagaucaggaaaggaggagguuaacggggcacuaggcacccagagagccucuugacaacucaugugaguguuuuccugcuaagacugugugcuuagugaagaauacuucugaagauugaauaugguuuucuccgugugugcugcagucuucagaauuguacuuguagggucucugugccacugaucugugaacuuucagauaggagcguaugaacuaucccuaaaccucacaagagaaaucagaguuguucuuaguggacugugacuacugacuggucaucauaacucccagaaacacauuucagaauguuggcuaaucucuuacuaaacuaaaagacaaagaucgguaaaugauauaaagcuaauuaugugucuacacugagauccuuucugaccucuuucccguuuuucucaaaguguaauugagcagauggggcuacauuuaguucuaauugcaaggcucaggcuuuuaauacuuuaucuagaaauauaaacuuugccugguuuagagugaagcuugggaccaaucauguagugccuucuaauguauaguguauaacagaauugaauguaugcauaauuuauguaauuagacaccaauugcuuuaugcuuuguuuauuuucucugauagagauaaucagaaucaaaauguuuggagacauaguccagaggaaagcacguggcaacaaaaauauagaauauaacaauuacuauaauuauauuucccaguguacuccuaaguuucuuaacagauacaagaguacuacagaguggccaucgguugucagauuuauuuuacuuuuauuuaaaaugugugugcuucuuguguaugccuggugcccuugauguuuaggagugguugugagcuaccacguagaugcuggaaaccaaauuugggucuucuggaagagcaauaaaugcucuuaagcuacucuccagccuguccguucccacuauaacaguaggcaggaggaugguuaggcuucugccacuuauagaugaaaacagguggacacuucauauucuccacauggguuuucuuuccccacauagguuucuguuuuaaugucuaagaaagauucguaccuagaauacaaagauuuuauuuuucuuuugcagaguuuuguucuucugucccuaaaaaaauguauuaauaauugguuuuuuucuuagcaaaauuaaauguuaguaaauucuuaaaacacauggaguuggugaacaaaaggaaaauuucuuacauuagcaaaaugaaaugugaagucauuaaguaacgguuugggcuuuuuuaaggccgccauugcuauggauaaugacaccgagauuuauuucuguuuaguaauaaaugccuaggccuuaagcuaggccuacucccaacuagcucaucacucaauuaucucauuuauacuucucaguuuccuacaaccaacuuccuccgaguccgaauagggaauaccccacgccuaauucugaguuccucucucuuccagaugucccaccuuacuauccugccuuuugcuguaagccauaggcuuuuuauuuuaaucugucaggaggugccuuaggcaguuggggaaggauagagacacaucuucacacaguguaccgaaacaucacccuaacaccauuacauugaaguucuacucucaccauguugguuagucggucucacucugguuucaugguuuaugcuuguacaugaagucaguuugggguucagaaacauaagauuguuuuaagucccugcuuugucccauauagacaaagauuacuuaagaaggaaauggguguuuguaacagaguaaaagaggaauggaguaauaaaacaagcaucucuaggaagcauaugcgccagucuuaaaacaguccucccugugaaacaacaaaggccaaguccuuggaauguguuguacccaaaagaagggcaacccagagauagggaugcugggcugagccccaaggggccaggcacagcaagcuugguugaaagagaguuugacucuuagagggagugucuuggagcuuuuaaaguggaggcuagucaauaagagaauuggugagaaguagaauguaggcuagaggaaaguguuaaagugaaaggaaaugguugucuuuagauagaaucggguacauuugagagugguuuauaaaccaagaaaaaaauacaucaaaacuacuuguugguggcuuggacgagggauuagggcugggaguugugauuucuggacuggucaugagauggacaacauacuguccauugagauuauauggaaucaagggcucuauauuggcuauuauguauuugagaucuugauuuagaucaaaugaaaauacuuccaaaaauuaccuggaacccagggagaaguaguauuucuuagcugguaagugauaaauacugacguguuuguugaagguaaugguauggagagacacagacuccggaaauuguuccugagaagucauaggaugaagucacucuugguguacugcuuggccagugacaagcucuugacuuaugaggaaagugaagaaaagcugagauuuaaaagguuuggaggaagugagcuuagagaaggaacacaauggaggacagaauuguggagauccagacuccacaguguuucaaggaggagggagggucuaacaguguuaaaaccuucacagaacuaauguuguguggcagacagaaauugcacaguagucuuuuuauucuugauuuuuuccccucccucgagcccccccacacacacuacuuuuggcagcuucucuauguacagugugaaaguacauuucacaguccugaaauuuacaaugaucugaaauuuuguucacucagaaucaaaagcuuauccugaaauuaacgaaauuacaauuuauugucuuuauuccacuaacugugauaauuacacauuuuugcuuuagaaauaccuuugauuauagaauguugucccaguuuuaguacauuauauauuuuuaucuugagucaaacuuuucuggauauucuuaauugguaaaacuauauuuaaguauuugaacaaaaaaugggaucacauuuuaaaugcccaaauuauguaacugacagagacuauagguacaugaaauuaagaaauuauguaacugacagagacuauagguacaugaaauuaagaaauuauguaacugacagagacuauagguacaugaaauuaagaaauuauguaacuggcagagacuauagguacaugaaauuaagaaauuauguaacugacagagacuauagguacaugaaauuaagaaaagaagagcagugugagguuugaucuugcugugcauugcaauacuaagugcaggccccaagaucuggagucugcacacagaccugaguaacaguauguggccuugccuucaaguuauuucugacugguaaauaaagaugccuacagccaauagcugagcagaagaguuguauguggggcuuaggauuccuauuguaaauauaaagguuguguguaucuuuuaucuggaaacuaaauggucaaagccaggguagaaacgccagguugggauuaagcguuuuaacaacagggcuggauggcuuagcaguuuaaaacccuggcugcucuuucagaggaccuggguuggauucccagcacucacaggguuguucacaggggucauucacuacagccacaggggaucugaugcugucuccugcccuccauggccaccagacacagucauauguauggcaaaaucaccaugcacauuaaauaaaauuuaaaaagaaucaguucagaaaacauuuucuuaaaaaagaaaaaggcagaagguuuuuuaguaagaaauagaugacuucaaagucgccauguauaaaacuaauagugaacaggaaacauuagaaaugaagauucuucccucuccuccucccagaaucaccuacccucugcugcuagagugcugguuuaaaggugccuugcccacaaaaaugguucuuguuuguuuuugaaauuauaauaugaucacaccauuuucuuccuuccuuuacucccuccaaccccuccuguguagccuuccaccugcucucuuucaaauccauacccuuggauuucuuuaacuguugauacauauaaauacuccuaaauacauaaauacaguguuacuauauguuuuuagagcuggcuauuuguuauuggauaaccaauggguuggucauuaccuggaggagauucuuuguccuauccuuaguccuuaguugucuguaguucuuugucuaggcuugaggccuccugaccuucacuaacgugucuguuaaugaccuuguucaggucauguuuagccagucauguuggugagacuuuguggauguugcuucugacaugucucacugacaggcuuacaguaaacuccuuguucuucaagcucuuuaaacccucucucucuuccccaaugcccucugacccuaagguguagggguuguauuguagaugugucacuugguacugggcuccaaaacucugcauuucaauugugcuuuucuguaauggucucugcuacaaggagaacuuuuccuuuauaggggugaggacuacaggcuccuguguuuacaaggacaauuauguagaauguagaucgggaugcugcugcuuuuguaaaguagcaauugcauauuuuauucaaagauggaugacuucaguagucuugaguuggcuaggucuccaauacuaggcaugauuucccucuugcugaauggaucugaaauccaauuagaaagcuguugguuacuguaaaggucugcgugccaccacuccacauuuaugcugccauggugguuguuacugugguucagaggugucauaacugcguaggacuauugguugcuucccuccucuggagccuugcaugacuccuuuuuauaauaugaaggguaguccucaagaaggauuaggcucucaguucuguccagcucaggggcuucuugggcccugcaucucaagugcaugaugucuucagcaauaugcaguuaccucuagggggcaaccaagggcaauagcguauaagauuuugggagucucuuggauaguccugaccagcaacuccaaagacggcugcguaguuuuuuguuuguuuguuuguuuguuuuguuuuguuuuguuuuuguggauaauggcuccuggagggagccugugucuauuuauacacagucuuauguguauuauagguacaguagggcaauggcaugauugugcuugauccuugagacauccucacuguuccucuaccguccucauuccuuguccuguauuugucuuccucccuaguuagaagccccacuccauuccccuuacauuuccuuuccuuccccuuccuucucccccuuugcguucccgucgcuccccuuuugugcagaggaauuaaaccaaaagcuuguacaugcuagagaaauguuccaccacuguauaucucaagccuuuggagggauucggaaaaauucauauuauggcucagcugcccucgugaauaugugucuuuuaggcuaaaugaauauucuuacugagaauaaggccucaaaauuaugacagaaguuugucgaaagcuguauauauuaauauaacguuaggagucucauaguuagaagguaacucccuucauaaauuagguaagccauccauuuuguucauauucgucaaaugaacaaauucgaugcugagcacaagcauguauacuguauucuuuccucauucgccauuguccugcuauuacauugcugugccagugacaauacaaaagaauauucacugccugugcucucuucuuccuaaaucugaauguagcuccuaucugcuaguuguauaauuuuggcuacauuauuuaacaugcuucucggcaguuauaaaguugugguacauccuagaguugagaaauaaaagcugaugcugaguacuaggaaaauguucuugcuguuacuucucaaacacuacaacuuaaaguuggcugcauagggagaacaucuggaaggauuaggggaggggaaaauaggacaaaaauauauuuaaauuuaaaguuaaauaauaauauaauaaagaaaguuucuacuuaggucaacaagauguauuguuuucugguucugaaguuuucauuuaccuuugaaaaacuaguuagcauucugagugcuccuaaauuuguaaaucauuuugugaaaaaauugaacuaaauaaaucagagguacuauaccaacagauucauacuguuugaaggcagguuuuguaaaccugaauguucagcugggucugguggcaaaagccaguggucucucaguggaaucaugaauucaaugccugccugggacacauagcuagaauuuugucucaagggggaacaaaagcaaauguuuucuggauuauugucaaguagauagauaguaugaaaauuucuggauuuuugauugccccuauauaagugaaaagguacuaugagaggagaguuugaaauggggauguuuguguuugagagcuggucuugcuguguugucuggccagccuggaguccuguuugcagguagauaaggcuugccuugaucuuacagagacuccugcuucuguuucccucaguguuagauuaaaggugugcacuaccauacccugcuuaagcuuuguccuuauaagggcagauauaugaagugugggggcugucuuuuguuguauaaaccugugcugaaacaguaagaucugcaggcuguuaaagucaggucaacuguccuaacaaauuaugaauauuugauuuuaaacuauaacauuaauaguaauuucucauuucuugcuugauaaggccauuguaaaauuauuccuuauagggcaggagaaauuacucagcaguuaaaagcauuggcagcuccuacuaaggacccaggguuguguuccuagcauauagccaucuguaacuccauuuccaggggaucugacacaucgugaccaccacaggcaccaggugucaaugcaggcugccuauguauauauaggcaagcucgcaggcacauaaaaguagauagugucccucaccuuagaaaaaguaauacauaaguuuucuaagcuuguugacaagcuuucuuauugucuaaaaguauuuugugguugaaaaucagauuuuggcauuauucuguguguuguuuuaagacauuggcaucugucuuacuuaguuuggguuuuacugcugugaacagacaccaugaccuaggcaacucuuacaaaugcaaacauuuauuuggggcuagcuuaguuucagagguuuagcucauuaucauggugggaagcauggcagcaugcagguagacauagugcuggaagaggguucuacauccuuauucaaaggcagcagcaggagacuccuucacaggcagccaggaggagggccuuuuccauaccagguagagccugagcauaggaggccucaaaacccaccuccauagugacacacuuucucuaacaaggccccaccuccuaauaaugccacuucccaugggccaagcauauucaaaccaccacagcaucuaagauguuuuaaugcacaggcuacuacuguguaguccugagaaaugaagacaagagugucuuuauuacccugaaaaaugcugugacucucccacuuguggacacugaacauuuaagcccuuccauaauuccagcucgacuguaagguauuucuacaggauuccaauaaguuauccaagaagcacuacuagcugacaaauuagauccuacuccguacuucaagaauacuucuuauguaucuaaauuuacaaaaugaacaacaacaacaacaaaaauccacuaaaaauggauuucaccuuaaggaaccaaaccagggaaauuggaaaacuaaaagucagaaaaacuuucucucuccacaaagaaugugaauccuaggcauguauaaaaucugcauaauauauuagauuucuaauguaauuugaauguuacaaaaacaacucuuguuuaaauauaaauuuuuugauguuggguacaugucaguggugguauuuaauaagcaucuuuucucuuuuaggugauauuggcaauuauuauuauggccagggucaucccaugaagccucauagaauccggaugacucauaacuugcugcuaaauuaugguuuauaccgaaaaauggaaauauauguaaguacuaguuggcacuguguuuuuaaacugguauuugaaagcucuucuuaggcugcugugggagaugcaugugguagaugaaaagaucugaacgaacacagacaggucuugugguugugucccucagagaacgcuuaaggaauuggaguaguccucucuucccucugaucauuucaaacaccaaauauuuuugugacaauacuguuaaguugccugugcugcuagaaacaauuguccugggguuggugagaugacuuaauagguagaggugcuugccaccaacuggauggccuguuuaccuuccccagaacucucacaguagaaggagagaccuaauucccccaaauuguuuucuaauuccacgugggcaugaggacacaccuccaauaauaaguaaccacaguguaauuuuaaaaagaaauaaaagagaauugaccugaauuauugcaagaguuugguagaaaauuaaucauaaauauuuauuugguuaacauacauaugaaauguugccaaugauaacaagguaaguaaaaaaugguguaagauacacagccaccuaaaaagucuucgaaacaugggcaggagcauacauaaaaagugcaagguaggauaaggcuuaacuaacuacuccaggagaagagggcuagacaguguuauaggaagcauuucuuuaagauacagguauuuuagagaaaugggaagacuuguggaagaagucugugguaagugaagcugagcucuucagagcagaaguuagaauaaacgaaggcuaagggagaucucaagcugguguucuuagaaaccuuugaugaaagucaguggguagacagcagcgaggcuaugcugggaaagagccugaacaaacaggaguagccucgcuuggagaggggcugccggcugccugcugccugccacaaaugugugcauuugaauuagcauuguaacuugcuacucagguggaucugguucauuuagagagacugaucguggaaacuuacacauaucauuugauaauucucauuuaacaacugauacuuccaacauccugguguuuuucuuuucagaggccucauaaagccacugcugaagaaaugacuaaauaccacagcgaugaguauaucaaguuucuacgaucaauaagaccagauaauaugucugaguacaguaagcagaugcagagauguacguuauaaauaauuauuuuacuagugcugaauguaaaugaaucuuuuuaaaguuucugaucagaguugccucaauagguauuuuuccucauaauuuaaaauauuaauauaauuauuaauucagaaggucauugaaccaauauuaauguuacuuuagaaaacaaaccuauuuaaauuuguucuuuuacuuuuuauuuugcacccaugaaaaguuugggauugguagggagaucacagaguuacaagagaaaaauauauuucuuucuuuuuuuuuuuuuuuaauaauuuuuuugagacagggucugacuuuguaaccagcuguccuggagauugcuaaugcagaucaggcuggccucaaacucccagaguuccaccugcuucucucuugcauuaacaauccuccauuucaccuucuguguacuccagucacauuguucuguaauguaaagauguugccuuuuguuggcuucuuuguguuucuuuuuauucuucuacauguuuuugauuauaggugaaaguguauuguuauugguagucaauuguauuaacugguagucaaguguauuaaagaaauauugccaaguauccugaaacugugggcugcugucuuuugaagcuuaauaccggagcccauuuccucagugagagguggauuuaguucagugaugacgaaugauaaggauuucucaaguucacugaacaccauauuucccuaccguauguuaucgcauuugguugacucaagacuggaauaggacggacggaugcuauuacaucuauuguuuuuuggguuuuuuauuugggauuuacacaguaauggguagccagcccuuggguaaaugacaggauuuguuuaaaccauuauagugcuuguuuauauuaaauucuauuugagcauaaaaaacuaaaacuuuuuuuauaguaucuguaggucuguaaaaccccugcccucuugcuaacgugugaucugagaagugaagaaugacuagggaugggccacacacacuucuguuguguuuuuuccucucagcacagggagccaaccaugucaugaccaagugacaugucaucugucuuauguuccaugaaacugauucauucauggcugcuucugaagucaguguuagccacagaaaaaaaacaaaguaacuuaauauuuugauacucacuaaaacauguuucggagucagggacacugugugugagggucaguaagaugaguuagaaagggguugcagccacuuaaucuuuaacucacuaucauauuuaaagagaaaacuagauuugugccuauuuucauauaggcuuuugauuuauguuguuggugaugguggugguuggguagagugacuucacaaauuuccuaauaagauuugguaauggaauuacauagauaacaauuuaauuaucuuguaaaauaagcauuauauuauaaaauuauaacuuuuauaauacuaccuacauugaaguacuacucccugugaauuuuaaaauucauagguaauauuuuaaaauuacaaauuucacauugcuaccaugaaauauuauauuauuaccuaugauugccugaaacaaauauuuuuaauaguuuauaagaaaaagccuucaaugacuugauaauagauugacuuuaaugaaguucaccuuccacaguuaacgucggagaagauuguccgguguuugauggacucuuugaguuuugucagcucuccacgggugguucaguuggugaguauccuaaaucagucagccucaagaggaucugaagggguuagagugucuguagguuuugucuaaagcggaaguuguaaugguaguaagguuguguuggcuugauuuugcuguaucacccaggugggccuccgucucagccaccucuguggcuaccucccaaaugcuugcuuacagacaugugcuaucauuccaacuuaaugaguacccaagcugucuuguaguucacuguggggcccgggcugaccuugauauuguggaaauccuccccuggagccucucaaucauugggauuagaggcuuggaauauuaugauauugcuauucacucuucuguuaauguaacaaaaccugcgguaacuuuuaaaagaaugguuuaucuugguucacaguuugggagcuuaacuggcccuguccuuggggacugugauagcacauuaugguaugugcauuugggagaaggccaguuuaccucauggccgcugaauggagaaaagaggauuccaguaucccuuucaagcaagaucagaucuccaguaaacuaaaaucagaucuuggcucuuagagaguccacccccuuccagugguaccauacuggugacuaaauguucccugggguucuuagaaggcauuucagguucaaaguagcaaguauaauugucuuuaaaaugccaguguuuaacaguuuuuacuugaacacagucuuuaagcuugugucuuuuuacucagagaccuuuuucuccucuucuuucuuccgccauuuuuacuaagacuuugcaugugcacugugauuuaguuggguaaacuguaggaaaaugguuaucugaggaaagcuuaggcuccgaaguuauaauccuuugcuuuugaaugccaaaccuuuugugcuuacacauggcauauuuaauagggcuucgcuuauauguauuuuguguaaccugauuuuuuaaaauucugaguauuuuauaaauaacauagcauguaucuccuucuuagcuggggcugugaaauuaaaccggcaacaaacugauauggcugucaauugggcuggaggacuacaucaugccaagaagucagaagcaucaggguucugcuauguuaaugauauugugcuugccauccucgaauuacuuaaguaaguuaauucaaacugaauuuucccugugaucagaucucuuaauugaaagaaaaaaaugauuuuaaagacuaucaaauaaaugguaauagauuaaugcugagucuuccaggguuuguugugagccccugcagaagugugagaaauagaccacuacagugggagagcgagagggcagacagugccgugccugagacugccgguaaauggucucugcucauuuagguuugcagucgucuaagcugauuaaaaauggcugcuagagauccggaaaugugaaugcuaaaguaacuugaagucaagccuuugcaacuuguguuauaagaaguuugucuggccacuuaguagcguggcugaccccaguucucucauccauccucuacacagacacacagaacacauagauaauagacacacagugaugcccaacugcugaagggguuuuggaaguuauccuucacugcuuuuucagaagugugaagguccuuaggaguguggacacuugugaaacuagcuuauuuuccacuguuagcuauaaugcugcagugaguuguauuucagcuuugacugcagcuguguucugugggcuuugagagugaugcucuugccccgcauguacaucccaagaguuaacuuccugaccuuaaauaaacagcagcuaagugcugucaguguaacauaucugacucccccaaccgacagaaaccggaaaucuccuucauugacuugaagcuucuuccacuggcuucaguucuagagaucugcugcuuuuuccuucauagcuuagucuugaguaagcccaguucuguacaguucuucaccugguaaaucugaacaugauuugauugguuugguaagcagcucucuuugcucaucuaaacacauugggcauuugaucauguuugauuuugaacuuuaugaagaaguucugcuaugaugaagcccgcucgcuguuugcacuauuuuagauuuucuuaguguugcuuuucugugccuugagaacauaaaugccuggguuugaucaugccagcuuacguuguaugagcacaguuacagcaucuuuaaauaauaaacaaaauguuuuaagucagccacagugacaagauaaucauuuacuaccuuaaauggugaauuuaaauuucauuuuguauguauugguguuuugccugcgugugugucuaugcaccacaugugugcagugcccauggaggacagaagaggccgguagauccccaggaacugcuguaagagaugguugugagucaccaugugggugcuggggauuuaaccuggauucucuagaaggcagccagugcuccuaacuacuaguccaacuuuccaacaccaguagcuuuuuuuaaauacaguuuuuuucuauuugcacuuugacauagggauggaacugaugucauucuaugguggagugacuacagaagcucauuugaguaguugcugugacuggugguguacagagcaucagggaaugaugaaggcacuugugaucugucacagucaugaggucuuaguaugcuguagaugauguguaaaaugugcucaucucgcuguaaaagguguuuauggauauggacauuggacugucucagaacugucauguuauaaaauacucugaguuuuguuuuauucuuggaccauuggaaaccggggagugggguggcacaccggcaugccagaggcagguagguuugagaugagccuggaugagcagcuaucaaaauaaccacagggaaaaggaaacaaccuauaguucugcucacuccaaagcuguugaaagaauaaaaauaauaacagcacuauguugguuacaguugcccauagauuauuuuauaaugcugaaauuuuuuuaauugauuuauuuucacuuuaugucauuuguguuuuguuuacacaugugucuguguauguguuggauuaccuggaacuggaguuacagguaacugugagccugcugugugggugcuggggacugaaccugcggccucuggaagagcagccaguacugccaacuguugagccaucuccagcccucccucccucccuccauguugaguuguguuguuuguuuguuugagauaggguuccucuguguagccaugggucuccuagaauuuucucuguagaccaggcugaccucagacucaagagacccaccugccuguaccuccugauggcugugaugaaagguguaugucacuaagcccaacaauucugaaauuguguaauguagcccuuggcauacccuuuaggugugaguacauagauaaugucugcccguuuuuaaaguguaaagacaaggguagaccucagaguacaguacucgauugucuugguagcccgaggagacgugacgugcuggggucuggaugcugagacugcgggggaagaagggugagcauucgcuguaagaugaaggaccugcuuccacauuccggcuugcgcuuuccuuucagguaucaucagagagucuuauauauugacauagacauccaccauggugaugguguugaggaagcuuuuuauacaacagaucgcgugaugaccgucucauuccauaaauauggggaauacuuuccuggaacaggagacuugaggguaagacugaguucugucagaauaaauauaagaagagcauaggagguugcuaauuucuggaagagccauguugucuuagucauuuuguuuguguauuugugaugggaccucggcaucugguguguaugguuuuuuuuguuuguuuccggagauguggccucaccuuaguugagcaguuguugggaucauugcuuacuguuaggauuugucacauguggacccacugaaugcugcuuguuguucagcugugauuacuuugaauauguagaaacgagggaucagaaguggucucaacucaguuagguguaagugcugauccuaaaaaguuugcuguccucuccagguugcauagguugucuuggguagcagggguggggucacaaugggaauggacaguguucuauaggugugggguacagauuaucacacugucuugugguagguugggagaggucaggcagugucuuuaucugagaucacaggcauagagucccagggugucuuauuaggugguguugaagacugauuuugggcucccuaccugggguuguguucucaggacuccauguugccccagaguggcgcaguggauguagaagcucugaggaucccucccuaccuaugggucugggucacagggcuccucacuuugagaaugguggauaagugggcucuacuuuuacaucuuguaaaauuguuucaugccucaaacugagguuuguaagaacuuuuuaguuuauuuugugugguggggaggagcacaugugugcccuguuacaugugcaggaguccuccugccauggguggauccuggggaucaaaccguggggaucucacuuguugggcuuuaucuacccagguauuucgccagcccaaacuacagugcuuguguguuaucuaaaaacugccuuagagcuuaaaacguacuucuacaaccuagaauacccaagacacaauuuacaaaacucaugaaacucaagaagaaggaagaccaaaguguggacacuuuguuccuucuuagaagggggaauaaaauacccacggaaagaguuucagagacaaaauucagagcaaagacugaaggcauggccauccagagacugccccaccuggggauccauuccauaaacaaccaccauacccagacauuauuacauauaccaacaagauuuugcugacaggacccugauauagcugucuccugugaggcuaugccagucccuggcaaauacagaaguggaugcucacagucaucuauaggauggaacacagggcccccaauggaggagcuagagaaagcacccaaggagcugaaggggucugcaacucuauaggaggaacaacaauaugaacuaaccaguacccccagagcucgugucucuagcugcauauguagcagaagaaggccuagucggccaucacugggaggagaggcccuuggucuugggaagauuauaugccccaguacaggggaaugccagugacaggaagcaggaaaugggaguggguggguagggaagcagagggaggggggaggauauaaggaauuuuuggagaggaaacuaggaaaggggauagcauuugaaauguaaaugaagaaaacauuuaauuuuuucagaauuguguguuacuuggucuuuuaaucauuuuaaaauaugucagacuuuuuguuaugaaauagucuucuaagaucuacuuuuguguuuuaggauauuggugcuggaaagggaaaauacuaugcugucaauuuucccaugagagaugguauagaugaugaaucauauggacaaauuuuuaagccuguaaguacugcuuucagaaauaaaaugggaguuguaaauauccuuagauacuaaugugucuuauucuguggcuagaucaucucaaaagugauggagauguaccagccuagcgcgguggugcugcaguguggcgcagacucccugucuggggacaggcuugguuguuucaaucuaacugucaaagguaagcaguucacguucccccuggugugguguuucuccuccccaagaacuucccauaaaaguuuucauugcugagggcuggagagaugguuaagaacacauguuccuuuuguagaagacuuggguuggaucccagcuccuacauguuggcucaaaaucuagcacucucuucugauuugcaugcaugugguacgcaccauacauguuuaaaaacauauuuuuaauuucucauuguuaccuuuugcuugccaacucgaugccaaacucuauauuugaauuuuuaguggauuuuuauuuguuguuguuguuuguuuuuguuauguggcugacuaguuaauuuaguuccccaagucuuacauguuaucauauuuauguuuauguauuuauccaugaguaguuuguugccaugucagcgccagcaguuuuuaaucaguuuuuucagaagaccuguaccuuguugucugauucaguugcuguuacagaguaugaggauuuagcuuggcgcacuuuauucuaucaugguuacucucuuccuuacccaacccuaagaacuucggucgcuguggcuagugcucagcagcagugguuuuuagcuuagcagucuucucuacuggcaagacucacuuuuuuuucuucuggauuuuuuuguuugcuuaguuuccauauuccuuauuacuaaacuaugaauuucuaauguauucugcucagcuaucucaggugcucugucacugagcuccuccuguucggacuuaguguccucauggguuuaaugggacagagagcucucugcuucugcuuuauuaugucuccugaucagugggcacuguaucuaacuugcugguggaacacauaagugucuucaugaggaaagaagcccaaguguaaauguguaaggugguguugaaauucucaaguccuuacgaagagccgaaguccacaugcugaauacaagucucauauugcuguuaugggaugaacuucgaggguuucagaaugaagcaaaguugcauguggcagcgcaugcuuuuagacucagcauuagaacagcagagauggguccaggccagcuaaggcuuuauauauaguaaaaccuugucucauaaagaaaaagauaaauaaaauaaaucuuuuuaauaaaguuaauguuuggauuagaaaugacuuagcaugcacauugcauguuuuacuuuagacuuucugugugaacuuugagguaguaaguaacaucuugcuuugaguucucuuacagaacuuuuaagauaauuaaauauagauguuaagaacuucucaugauuguacucugcagaccagccucagcacuguggcaugcucugguacucuccuucguaucuaguugggucauacaaaauuaguuggccacucuccuggaggucagcauucaguuaacagcacuuucaugugggccauagaauguucauagauaucucguguuuccgagcagauaagacuuaaccggaagucaucagccaccagguaguuccuuucuuuuuaggagcuauauacuguuaguguucucuuuuguaacugaaaguuuauaaugcuuguauuuaaaaguaguagcuuucauuauaaacugcauuugacucuuuauaguacaucugcauuguguuucaacagguagaaguucauuugugaauuugcaauuccauuuucagacuuagaauacacugcugcgacuggcuucaacuacauugucucaggccuagugaagccaagcagccagcugcuguccaccuugccuccuuaauuauuucuucuugugguguucuuuuccgugcuuccucuuacggguuauagccuucauuguauaaaaccccuuuguaguaauuuuuccugcuguugggugguagaaugcuggucuugucugggcucuuucauuguacucugaaguuaacuucuguccuuaaaaauguccaagagacacuguuguaguagaagaugccugguugauaauguacaugaagaaaacagagaaggcacuauaaacucucacuagguaaugaggauuuuuuuuucuuuuguggcauuuucuuuuuuuccaaauauuuuaagcuuuguuauagaaaaguuacaaaaacaaacaacaaaaauaaaaucacacacugaaauuaaccagacccaaagauucaaugacuuuugugcuuagagcagccagcgucucaauaccaggugaaagcccacugcaaaaggaaaugacuuuguuuuuuaaaaaaaaaaaaaaucuuuuuuuuaauaaggcuaaaauccaugaaucucugcugucaucauugagggacuuucuuucuuuaaugguugaauuaugugccugaauggcaccagaaguuacuggaaacuuguaacuuguuccugugugaggcuuguaaucuguuuuguuuuuuuuuuguuuuuuuuuuuuuuuuuuuugguuuuucgagaaaggguuuuucuguguagccccggcuguccuggaacucacucuguagaccaggcuggccucgcacucagagauccgccugccucugcugggugcugggauuaaaggcggagguuuguaaucuuaaauaaauuaagaaaauuauccacaauaccagcaauaaggauacucuguggucaaacuuuuugguauugcuuuucgaaauuaagccacacaugucugugcgggagaaacaaaauuuagcauuuguuuauuguguucucucccuuaugugaucucucaugaacgucuucuaugguaguaaaauacaugugugcguauuuuaacacuuaguacaaguuauuaguuggauauacacccccccaggccccccacccucgucaucauccccugucauuguuccucccugccccccccaccccuacccccccccccccaccuuguguugaggugccugccuuguagucaugcuguauagacuggccucccaauucugauccacguaccuuagccucccaagagcugggauugcugguaugugccacucugccuggcugucuacagacauuuuuugguugaguaaaauuguuuguauuuauccuuuuuaagguccuauuuuaaauugcuaaagaauacauauuucauuguuacccaaaucuucuuugucuaaggucaugcuaaauguguagaaguagugaaaacuuuuaacuugccauugcugaugcucgguggaggaggcuacacaauccggaauguugcccgauguuggacauaugagacugcaguugcccuugauugugaaauucccaaugguagguguucagguugcaguaucuagaagaacaucugcuauguacaaauggaugcaugggagagucuacugccacaccccugaaaugugugaucucuucugauggaugagugguuagauugcaaaucugugugagagcauuccaugugcacuuucaagcuuuccuuugggaauaguucuuuuaucuggauucggauuauguuucugagauuauacggaagcuaagcuuuuaauguguaacuuguuuuuucauuguuuuuaauagaguugccauauaaugauuacuuugaguauuuuggaccagacuucaaacugcauauuaguccuucaaacaugacaaaccagaacacuccagaauauauggaaaagauaaaguaagaaaucacuucggcuuaaugaaacuucaggaggcuauagaaggucaaauaaaggaaguugguuuagcauauacaucagauacuuccuaaccuuaggcuauuccuguuuuuuaaucucuuauauuaauacaaauauguaaccuuuguaaauagaaacauucuuauuagaucaaaugcuuuaugucuacagaauguagaaacauugaucagaacgggcuguguccucucucccauagaccaguuguaugacauuuauaaguacaccucauugucaaauagaggugaaaagguacauguuugugugcuguggguucagucagcuaauauaugcagugaucugaugcuuagauagugucccauucagugguuaguaaaugaaagcucguucuuguuuaguuccuccuguguauaacagaaacuuuacauacaguggauuuugucuaauaaauugugucauuuagacagcguuuauuugaaaaucuacguauguuaccacaugcaccugguguucaaaugcaagcuauuccagaggaugcuguucaugaagacaguggagaugaggauggagaagacccggacaaaagaauuuccaguaagaaaacccuugcuaugucuucuugcauuuuucuuaugugucaaaauaagacuuaaaauugaagguacacagggaaugguucacagcacauguugugauuuuccuucucuccauuuuaauuacauauagauuuagcucccugaugucucaaagccugaauuaauaucaccaguuucauuuugugugacuacacagacauggcuguguccagaaaguaggcacuugauauaucuaucuaucuaucugucuuaccuaugcaaugauuguagaaccuguggcuauuaucaaauuuauaaaaucuuuuguguaucaguucgagcaucagacaaacggauagcuugcgaugaagaguuuucagauucugaggaugaaggugaaggaggucguaggaauguugcugaucauaagaaaggagcaaagaaggcuaggauugaagaagacaagaaggagacagaggacaagaagacaggucgguuuauguuuuggugaccauuucacuuucccuacuuaaggguugcacugugucucuuagcgauccugcagucacacgucucacuuuaggcagguaacuuuuccugguguaagagauaguuaguuaccgcucaugcuuacuguuuagugcuucagagcugacuuaaagguuuuacaguugugcucaaauuuucuuugugguauagaaaccuuccuuuuaauaacauaguaguaaacguuacaugucaugggaugggguuaaggggaugacaguaguuacagauguugggccucagaacauuuacuguagcuuagguggacuuagacucagugcucuucugccuuguccucuuauauacugggauugaaggcaugccaguacaccuggcuaaaauucuaaauaauuuauacugguuaaagcugacuucauguagcaaaaguuaagcuacauaguccuuugaaaaguuacuuuaagagugaagacucuuuaggaacugaagaaacuaaaacugaggaaagauaggaaggggcaguuucuggugucuuccgguauuucauucagaguguuuauuuagcaugccauuacagcaccucguuagcacucucagguuucucauugcuaugcugaacugugcagggguaaggagugggcaguagccucuuuaaacaugauaaugcugcaaguuuuaguugaccuacuagucaagugaggcugccuggcuuuacuaggccucacuauauagacauggcugcuccggcuacuuacuggguggccuuggauucacaccauuguccuuucucagaugccugggugcugggauuacagaaaugugccaccaccuccaacucaguuucuuucuauuuuaaaauaucuucugcauuuucuuuuuuuuuuccaaauaggaaagugauaaaguaaauugacucuugguauuuuagacaaaauaccacaauaaucuaugggucauaaccucaaauaagacccaccaccacccccucuuggcacugaguaaaaauuuagccagaauuauccaagacacuaaaaugugaaaucuccauugucggcauguagauuuguaugggaggugacagcagugcccugcagugucugcauugcccaagcgugcugcugucccugcaccucuccaugaggccauugcuucauaacuaauuuacacagagaaaauacucuggcuaaucugggacauuuacuuuaauuacuguauuuaaguuaugaaguucaguuuaguaguaauuaaaaauuuaagguuagaacaaugggauauugugggccagcaagguaaaggugcuugcugccaagccugauuacauaugaucugcauguuggaggaagacuccugacuucuacaagcugucuuuugaccucccuauggaagucaugguguggaugcccaaacauacacacacacucugaauaaauaaauguuaaaaacaaaaaacauaaucuagccucuugccuuuaggaucacguccuucuuacagugcagacacaguucucuugagcuccuucugucuuaccacugcuuccgugccucaguccuuuuacaguuuucccuggaagauacccuuuccucuuaccugagaguuuguucauucuuugggacccacauucuagagaacugugucugcacuguaagaaggaagugauccuaaaggcaagaagcuaaauuauuuuuuuguuuuuaacauuuauuauauauacacuauauacauacauauauauauugugugucuuauauuucaaaauagacaucaauauuuuucuucugucuuuagauguuaaggaagaagacaaauccaaggacaauaguggugagaaaacagaccccaaagggugagcgaugcuugugucuguagacgucaugcaugucuuggggguugggcgggggcaugcauacuugagaaauacuggcacagccugagaacauacaaugagugcaggucugcguguggguaacgugcuuaggcuauuugaccgguaacuuuuauguaugcaaucguguuuuucaugaugcucauauuacugugcuuagaauacuuugauguuaggagacaggcuaguuuaaggaaaaaacauugggcuaagugaaagccuauuggagaauuuuguuaucagaaugcauguauggcuagguaggugaaguguugcgguaaaucuccaacccaaauaugcccuggcaaugaaacacaacucaauuaauaugaauacaugcugugugccuagaaugggcagaucuaccgcuacacuaccaucgucaacaacugugagagcccuuagaacuugcaguuucuccaggccacgugcuucugcuccacuuuucuucuucccccuccucugcauccucacccuccccuauuuucuccucucucuccccaccuucuucuccaccuucccuuuaucugcccaaucaucagcucuccuuuauuuuacaaauuaggugggaagcagguuuaugggaaguaaaccugagugcugacucauugcuuguuuguaggcccucacuggagaaggaaguagcaucaaauauaauaaguaagccccagggcuauccacaccugugaagaggcuugagucuauaaucucaguccacuggagaggcugagcccagaggauugccaugaauuuaaauccacacuaagcuacauagugauuuuuaaaucgucacucugggcugaagaaugagagucuguguuagaagcaagcacgugugcuuggucacccaguuguuugcuaauuuugaaggauaacuuagaaugcucaguuguaaaacaacuggaaagauuaaggcuuuuauugcucagaaaaaaaagaaaaaacaacaacaacaacaacagugaauagcuuggugugaaucuauaagacugugcaaguagccaggucagugcuccuaaaccaagacuauuacuuuuaauauuucaugauccucuuucaacagagccaagucagaacaacucagcaacccuugaauuugacucuccaacuuuaggaaccucgaaaagugagacgauucugggauaagaaaccuucccuguuugaggacauuggcuucauuuuauacuguuuuggcauggacuguauuuauuuucaaaauggcuuguuuuuguuuuucuuggcaaguuuuauugugaguuuuucuaauuaugaagcaaauuuuuuuuuccaccaugcuuuaugugauuguauuuaaauugauguguuauuaugucaaaagccggaucuauuaaagaaacaauuggccuuucugagcugauuuuuccaucuuuuguaauuaucuuuauuaaaaaauuguacuugg

SEQ ID NO: 12455 - RNA, 21514 nt, Mus musculus
acucggcccuccagugucgcggagacgcaagagcagcgcgcagcaccuguccgcccggagcgagcccggcccgcggccguagaaaaggagggaccgccgaggugcgcgucaguacugcucagcccggcagggacgcgggaggauguggacuggguggacaugagagaggcuuaucucagauguuggaucuucucuuggaaaaacguguggguacgaccuugguaaggaaccagauucugucuuuaauacgauuugaaaccuuuuaucccuuuuucuuucuuccuuuuuuuuuuaacuuuucuuuucuccccccucccccuuuuaaaaaaaaaaaaagaaugaagccucaguagaaaccagcgcuucuguuuuaguacgcggagcacugucaaacauuuagaagacuuuuuuccuccguaugaaucauuaacccuuucaguucuagacauaauugucaauucacugaaauuucaguagugguucuuguccgcuucgccacucgcugccuuuacauuacuguaacuaucccggguugacuuagguuuucacuuguauuuaacaucguuuguuccacaugaccuuacauguuggaacuaaauaagaaugagauaguuuaaguuguacccgggacaaggacaaguaagcaucuuuccccuucucggagcguccuaucuagggacgaauuguaaagaccagcuccggagagggacucccgcuguacuguguuuacauuuucacaagcgcgcguucuaacaugguuauccuuauuccuaauuuuuaucugcggcgucuaugugggaauacguugcagaggcuguuuuaucuuucuugcuuuuccucuuuggaaaggacuuuuuccgagggcagauaagaggaggauccccaagucuucuguauaacuuuaguuacaguaaacugugccacuucagugacuucugggaauucaugcacuuucacauuuaaauagaaagugcuauuuguggcugagggcuccuaaaggaauucucuucagggaauucuauugacuuuuuuuuuaauauguuuuguuuuuaauuuuucuaucuggcucgagaugcccacggauuaaaaaaacaaacaaaacugcuggguguuucccucuuccccaauuuuucuuuuccugugguccaugggagcucgggaaggcugguacucaaggaugcuggcaggaugcaaccccucucaggcuugccugcuggaggaugaaagagacugaacgcgcgcgcgcgcgcggcagagggaggggaccuaguuguuuugaaaguugcuucgcuagggagcuggugggaaaguucaguuuuccccauuuggaaaaggcagacuggguuccgcuccugcaccacacguguuuuccauuuuuagcuucauucagacgcaggcagcgccccugccucuuccuccccuuguuugugacacuucucugagacagcuuuuccacagcucugagggucuggcggccaugaccccgggcgucccgggacacaggacgcagcagcgcccacaacacauuucugccuugagugauaaagccaaggauuguucaaagguagcuguucuuucucucccgaugagguuaacauauacauauacgcuuuuuuuuuuuuuuucagccaaaggcugcauuuuaaaaccgugcuucuucaaggcagucuacuuuacacggcuuuggacucuuacucaacuguacaaguacuccaagcuuuuaaagucuucagagcaccguguuagucauagccucuaagagggaggcacaggagcgccggacaauggggauuaaaagccuuucccuucucuuccaggcugcccccaagucuagcuccggcuccgugaaguuucaaggacuggcagagacugggaucaugaaaauggacauggaggacgcugauaugacuuuguggacagaggccgaguuugaagagaaguguacauacauagugaacgaccaccccugggauuccggcgcugacggggguacuucuguucaagccgaggcauccuuaccaaggaaccugcuuuucaaguaugcugccaacaacagcaaagagguaagccggcugccuucuugaagucugacuggcaauugggccagcucuccuacuacuaucucugagaaccgugagaauuuauaugcauuggcaaauaauugaucgcuccaguggcuguuuuccuugcuuucucuucaaaccaauuccuauucauuucuuccucccuucagcuguccuauacuaauuaguaaacaguuaaauuuuuuggcaaguugacaugucuugggaaagcuaacuggcagcacuggugggcagcaugguaaagggcucagugcuucacccccuggcccucuuggaugacaguuuuaaaggaaagaaacuuccuuagaaaaagaaguuuuuccucugcucaugagauggcuuuauucuuuuaacgagccagcuuuauuagcuggguuucuaaaauuauucucaaaaccuugacguguuuaugaacugaagagauggcauuaaccaggaagagggucacguaaaaguguccucugucaggaugacuucacuaaccacccuuuaccuguggcagcucccuggccugggccaggccggcagguccauguuuuauggcuucugaaguggguacacucuuuguaucaaagacacagaacaccugaggagcaccugauuuguguuuauauaacaauuagagucggcugugaagugauuugcaaaauaacuccuugcucugagaaucuggcugcugcaguugcucuccugauggcuuaaguugcugaggcuagcccucaggagacuucccaccaucaccauugcccacagugcugugguuucugauccuugcugucuuuggggagcagugaaaggagggauucuguguuguaaggauuccagauuugcuccuaggacuaugcauuaugaaagugccaggucacuuuccuccuucccuaagcgacaacaugggaaagaaacuccagaguuggggaaacacugucucuuuccuguuugugugucucaguucaggguuuggggggggaaggagggagguggcaaagaccgagagcuaaacuuaaagagaggaauucuaccuuguguuucacuaaagcuccacucuuuguucuauuucugaugggagacuuauuuguuuuaugaaaagcaaauuuuaaauuguaguuuguguauaaauaccaccaaaaaaaauuguaaccccagaggucacccuuaauuauaccucuuucugaaaacaauguucuucucaacagaaagccucugaguauguaacccguggagucaauguggcguuuguuuggguauuugaggucuggcuguggcuuuaaaagguguaguguguucuccccccaucagauuugccuaaauauuggucccuucaaaaagggccauucauguccuguugucucuguagccuguugggauagaaauaaagacuccugguuuuuugucaucggcucuguucuccuucagaguccuucucagcucagcccuauaaaguuuuucaauuuuuguuguucuacugaaaacuauggcugaacggaguuaugcuauuagaucauuuaguucaagguucagauagucaacuuccccgaaggcuagaguuacagccaggcccagacugggagcaaaguucucugauugcuccagguguuucuagaucaugcuacucuggucccucuuggugucacuguggcuuuauuuaucuuagcauaauucaggcacagcuuuucacuaagccuguuugauucuguuucuuuucugcugaauuccuucccaucucuguauguuaagcaaccagaaagaggcagcucuuguguuucugacagggugcccuucacaacacacagaaagucaggguucuuugagccuacucuauguuuuaccgaaagaaaagucaaaucguugugguagcaccucuucgguccucaaucaugaaagccaccaggaaacaaaauuuaagcaucauccuauccuaagcauacaccaaaaugugggccuguuuuucccuucucuccagcgccuucuguuuugaacuuugggacaggucccuugggguggugaaagagaaggacagaauugagccauugagggugugauagcugcaaaccaguuccaggccagaagcaucuaggauggaggaaguguuuacauuaccauuguucaguuaguucugugaguuccaugagcuguagaaacagggaaaggccuuucuacguguagcuuuuaucugacugaucuggcuugcccaucuuuaaauguuuucauuaaaauagcaaaagcuguuacuuuauguacugugugcugacauccuggggacuuuuuuuuuaaaaaaaaaaaaaacaagaucauuuuucauuaugaauuugugcuaugugucagcaccuucccacccccacccccacccccuugauuuaaaaacaaaacaugcaaacuguauuucugaucuuaacaucaauuuuuagcucuggcucagaaucauucuguucuuuuauuggggccguuugaucauucuuacuuccuauuuccagaucuaaaaccaaguacaagcacacucuucaaaacuuuuagaacguuuaaccggguggguucuucuuccgugggauuucccccucguccuccugaaauaaucucugaauauuugacugcauuaaaaaaaaaucaguuuugacauugggagagcaguauccaggacaacuuucugcugucagcugagguggcuuguccucaggcacuguguggcuccucugacucuggucugaaguugaguggugacaaacaucaggcagaucuagggacaugguguccauucugauugaaguccauuauuaaauugagccaucuguauggaaucucagcacaacaugcaauuccaccuccggacuuuuuuauuugguaguaugugccagagugccaccacaucucccuucacauaaagauaacacgaagcaggagaccuuucaaaaacaccugcuaauuccuuugaaaacuggacugaaguacagacuugauaucucggucuauacccuuauaguaaaaauacaggaaaggaaaucuaauuguugggcgagauuuggggaggggaaaaacagcaaguaauuaaaguaaccuuaauuugaagugaggaaacucaggccacuuuuggaacugaauagugucuccuuucaaaucccccugcuuucuacugggcuccuauaucgaacacucucuaaauggcuguuuguuuugaaagcaaacaaacagaccuaugcugcccuuaucauccgacuuucauucuguacucccacucccacucacuccauccugcacuguaggaaucuuucuuuucuaaaguuaaaaagaagcucugcuuuuugucucugagcuccaguuuguguccuauagccaaagccacugacagagacagaugugcccagguggcagaggggucggcuccgcaagucaagcaagccaugaagagcuuccguggggcugaagcaugggcagccuaaggaggccucuuucucuuccugauggguguagggaaggcacacagcagccaguccccaggaguaauucuuuaggacccuggucaguuccagugaaguuucuuuccucaguuaggugagcacacucuuggucuuuuuagcagugugcaacucaaagcacaggucaaguuucucugugcccucugcuuguuccuaggguagggcacuguaaacaauggguuaggaagauggguugggcuaagacacucaucuggaucaguuuccugcuuuccauuaagaacaacccuggcucuuacccccauccuaagacaccccacaaucaccauaaccuuagagccgcaguuucuaugucuucuuugauuaaggaaucagacauggauuagacgugaagguguuuauuguguguuguuagcaugcugaacuugagauggcuauaggugguuuauuugauguucuuuuuucugagauagaaucuugagaugucuguagucggaaugcaggccacaagcugcugaucuuccugcaugcuaugauuagaggcaugcaccacaccacaccuagugagacaggugauuucgaagcuacaggguuccucuaaccucagaaugcugaauugugugucucuguuuaccuaucagugugaauuuccucguguucuucagcucuguguauaguaggaauuuuaaauaucaagguccuauuguacucauaaaaacaaucuaauauugcauuuuggucugguuauauuucccagacugaccuuggacucaauaaucucuugccucugccucagaguggcugggacuugaagccaccccagaauuucugguuacuccuuuuucucucauucacaugacuugucuguugaguugcauuuguaagguuaaagauggcaggcgcuccaaacacugacuuaaacagcuacagugccaacuccauaguugugccuaaaagguccuagauagcuuguaccuucuuucuuuuucuccccccccccccccccaagauucuaaauaacuuccuuuuggccacaggacaauguguuuuguuagcguuaaaaucgguaggugaaaaccaagcgucucuucuguagagagaauggcaaucuggaagggaagcugugaccucauuguacugcuccuuguugguaaucaagcucugacucccaagaaacugugcgcaggaggcuauaauuuaaaacaaaguugaugaaccagucgagugccuuucuuaaaauuacugcuuuaaaguggauauguugaaauuaucagcugcuaauuauuggcucccugacaaauggcauuauuuguuuuuccugcuuggcauuuuaauauuauggaauaagcauucaaauguaaaugucuaauaauuuguguauuauagaagacaauuccauggauuuuacagaguggguucaauaauucacccgaacaagccugggaccggaaaguguagucaagcauucuguguaaaaauuuaucuccagagucucugcucugagauacucuuguucccccaaagcuaggcuaccagcagacaccaccaaugaggaggugucuuggaagcauagacaggugugacgagggcagaggaggagacgaacaucugcuuucuucagaccuuugccacaaauucaaacaggaccaaaaauaacaccuuuaacucaacgaaucuguuucgaauugugcuggauauagagaauuucuccucuccccuuuccugucuuaagaaugcccuguuaacauguauugaauauuaaauuauuuaacaaaauggcaucugacgauaaaaggacaccugucaugagaguggccuguccccacucuucauguguguuuauuccacacuagacccgaguuuuaacuauggaugaggcuggauaccaguguguaucacaguccaagucucagauuuccacucaaacuaccugaagagacauugauuugcuucucugcaccuaccauucaggaauauaaucauaggagaaccgucaacaaaaaaagccaaguaaagauaaaugcugugcauugccuugcccuggcucaccugccacugugaaagggguacagagucacucugggcucauuugaauuacuuccugguuugugucugaguuguguuguuauuuuuuuuuuuuuuuugauaccguaaaaagaaaguuaugcucaaggaagaaugccauaguuaauguguuucuucagcaaaccccacagagucagagugugugaggccuucaguuugaaaaggucauuuccucagaucuuagaagccacaucuuuuagaacccacagucucauuacauauuccauuucaaagagggacuucugaccaccauugaguagauguuggagaagaacaaaguuacuugaaagaucuuucuaguaaagagcccuuaugagcuauaagccaaaggggauggagaugucaacuggaauuuuaaaaaaacaacaaaaaccuuaauguguuugguuucugguucccucggccucuauggaacagcuaaagagcauuauuuugguuucugagguuaaaacucuugcauuuuccucaagcaugguguuuaugguuugagggagaagacuggaacuagggaacugagggcaguaaucuugacccccucucucucucucucucucucucucucucucucucucucucucugccuucugauucucuuagaacggaacaucuucuggucuuccaacaugagaggccauagagccgagucagucacuagaaagcaguccguccccgggacuauuucaguuucagcacuuggaugacuguaaacgaugacugucacgaagcuuacggcuaacuguggaggcauggauggugccgugcuggguuaucaauugacaguucaauucacucagcuagcuagcuugccaucucagagucugacuaaugaccucauauuuuuuuuuuccccuuuagguuauuggcgugguaaguaaggaguacauaccgaagggaacacgcuuuggaccccucaucggugaagucuacacuaaugacacaguucccaagaaugccaacaggaaguauuuuuggcggguaaguaagaaaaccuuuuuuuuaagacuuuucacuauaggggguaaauggagcuuaaagaacaggcucaguucccuuucaacacagcagggcucacccagggaaacacuggaauucugagcaaguucccuagaacugguuaaacgcucugccuagaauauuagcuggaggugguuagauguggacuaccugugaaucucaauuuuugcaacucauugcauacaggucugggagggaaggaaacaguuugccgcuugcuucaagggcaggcucauuugcauuucucuucgaggaaguaguaaugagucacggagacuuacauuucacccuuucuugauuucuugcugaguuaacuucauuugaauggaagaguuauccugagugaacuugaugucgaagacaaaugucacuaagagagguagaugguggguuaguggaacugggaaggaucauggagcuaguuuuauuuaaauccaucugcaccauaaaacgguuacauuugacaguaucauaguuguuaagcaugaggaaaauccucgugugccuaugagauuguagacucagguagaauaacuauucuaaaggucuggccuaugcuaucuccuuuggagugucaggguuagcgaggauucugaggugaccugggagaugggauucauggguaaaaauuguucucugagaugucucuggcauguucaguuuuccucaguguagaaaugaagagcuauuuauacaaauuuagugagcuguuuuccucacacagacaugaaauauacaccacccagagaaaugguaauauccacaacuggauuacaugagaaaaagacuuugguuaaaaaauuacuuauuccugagagagucugucuucagcuaggaagucuuuguuuccagaaacguacuacuucuacaacugcaucuguagucuuguuaaguauuuguucucaauuuuuauuuauuuaauacuuaguugguguuaaauuauauugcuccaagaucgcagucugagauuaugagcgguuucgcccuuauugcuguucucagaugggagccaccagugguagauuaaucuuggccucagcugguaugaaugaagacaauccgacacugucguuuugaaaacggucaagaagcaccaaaggcucucccauuacuguccccacugucccauuuaaagauuuacaaaaagaauuagacuaaauaacuagaaggcuucccuugggaggaauuauuuaagucaguuguccacaugcaaggaagacaggaaugaaucuuuucacagguuggaagauccugauuugucaagcaggaauaggaacaucucuguguugugaggaaugaaagguugucaugcaaauuacacagucagagaugcucagguugagaaagcagugacauuucuuguaacuguaguaugaaucagcuuguguuuagucuucuugauacuggauggaaaggcugguaucagugugccuuuuacaaaagcaugaugcuaguuucuuggggugcgugugacuuucacgacauccaagguccuuuuuuuuaaaacaaggauacaguaaaccguagccaugaaaggccuacugggaucggcacacccucugcuagcuguuuccacccugguguaagggcgauggaaccccuuguuccuggaaguuugcgcgucagaguaaacaaacuugaaaaccccucuugauagcagaauccagucggucuuguuacauuuucucuuaacaagauacaccgcggaagcucucgcaggcugcuuugaugaagccacacgcaccccccacacacacacacacacacacauacaauucacaggaagucucucuuaaaagaaacugauucugcuguuuacugccuguguuaaagggacagaguuccuuuuuuauuucugauaacguuagagggaaauacagaaacguucacacagccugugugugacuaagaauacagcaaauagcccuguagagcaaacucccugaggugagcauggaagcgccguaccucuuggagacugucuuguguguaaagagggcucucugcucugaaggaaggcggugguucuucaaggagaggagcuuuucuggagaggaugaggagugagucuuugaccccuugguuucaguaggaguguauuucuccccugcucuuaacuaugccuuuaaccaagcacucugaguacagcugugagucagagguagcauugcugaagaagaaccauauauuuucuuucucuucuuuuuccaaaaggccaaacucguggcucuuguguguguagaccguguaugccagccuccucacagauaugggcaaaucucucuacuccuuuucaagagagaggcacaggguggccgccuguguuuaccaagaggaaaaguuacuucucgauaggcugucaaacuuuggccuccgugccagugccucacucuguuauggcaggugaaguucaccuuugccccacccaguguuuccacaaaaaggcaggguuccaaguauucaucugaacaaguguuacugugggacucaggguuggggguggaggauguuugcagagccuaagccccgggcgggcggagguguaggaaacacaaguacagaggccauagaaaaaaggugagacucaguuugacgcaguccucucggcugcugugcccagugacucaaagcacuagaagucagcagaguuggaacucugggcugagcagagucgccugaucgauauucgcuacuguagcaagaguaccucuuuaugguaguuucacccacucucggcuguuguuaauuggaauauuauuauuauuauuauuauuauuuugcuauccacugcccuccccaacaugagaagaccauaaaauugaaauggaaagguaacuagcacaaugugcccuguuuccucccccauuucugcugauucagcgugagucccaccggaucagcaaugaggccuggagucauggguacagcguugguugcucgccuguguuccuucugagccauucagggaagcuucccggucgcuuugggcuggccggcugucuuucacacugcaucuauccucuccuuuugaacagaucuauuccagagaggaguuccaccacuucauugauggcuuuaaugaggagaaaagcaacuggaugcgcuacgugaauccagcucacucugcccgggagcaaaaccuggcugccugucagaacgggaugaacaucuacuucuacacuauuaagccuaucccugccaaccaggaacuucuugugugguauugucgggacuuugcggagaggcuccacuacccuuauccuggagagcucacagugauaaaucucaguaaguggauuacagaacaaaaaaaaaaaaaaaaaauuaaaaaugcuaguaaugucaguucugccccugugagcuaauaacauguugucuaauuauacggcuucgucauguguuggacuaaguagguggcuuuagcuaagacgaggaagaggaaaaacauucuuuaaugucccuacuucuuauuauaaaacauaaucaucaaagauauacauauuacauauauuguauaaaauaaccaguacagaauguuguuuucggaaaguugcaggaagaaguauauuuccgauucuaauuuaugcaagcggcuguaggcacaaucccaauggguauggaccuguggaacaggccagcugcagucccuuccugcugugcugggucagagcuuugaguuuucacugaaaucuugugaagauacgugugccuguaaagccaugaucuaauguggaaagcuguuuucuagaaaaaaaaaaaaaaacugucauaauuguucaaguagucuaagugaauaacccuaagagaugucauaucugagcuuccuuccuuaugguaaaggggacugaucucaucuuucaaucaggcuuacgguaaccgccuaucucuuuaucuugacaaauucuugcuuccuuggguuuauaagcuuuuacuuuuucuuuucuucuuuuuaaauuuuggcuaaaguuacugucaugcccucuagcaagcuuucccucuucagucagucucagguagcuuuaggaacaauuuaagaauaaaaaaaaaaaaauucuaacuucuauuuuaacucaggguguguguucuggguuauacugccgaaucuuacagcacuuuuucaaaugaccaucuucccaugaaagcuaaauguugaagguuuaaaaguuuucauuuuaauagucucugaaauuugaguaaacauuuccagaaaucuauagagaguuccaagcuagacuuuacccaguuucuacucuucagucucauuugcuuucccuggagacuaaauguaguucauauuuuaccacugaagcacuagaaauauuaauuuuaguauuuuaacuuuuaagaccaaggacagugucucgcuagccauguucauucuacaaugcuugugcucucaggaauuuucaguuuucugaaaaucuuagcuucaguaccuuuccuguaggcucacaauauaguguuugugcccgggcccucagcucagcaacguacacccuugagcuaagcaugguggguagguaccugcccaauagcagcaagcccucuccucguguuuggguuugcuuuggguguuuguuuguuuguuuguuuguuuauggacaaggucucgugcugcuuagguucaguucagacuugauguagucagggaaagccuugagccacugucaccuccaaaaugcuaggaucacaggccugugcccuccccccaccccugccucccaccauccccccaaugccuguuccgaguguuuacucuuuguguccagaaguaaguuucauuaugcuaugaaaugacagcuuugcucuucagacacccccccccuuuugacugaugcaggagucuucugagggucacaggaacaccuccuuugucugacauuccuaggacagaaagagaguuaaccauucagcugccgugcaaggcucuugcuccugauugugaaaccuguuggcccagguguggccacugaugacugacacucugaucaggaaaauuuccagcauuucaucaggccuaauaggcagaucgaguguccaagaugggcugugcuagauuuccaggcuuaaagcacaauagaggucuguccagaaucuccguaaggacuuccaucauggggugcaggggauggaaaccuaaugaaagaauguaaguccccagaaaucacaaacugacaggaaagagaagggagagaggaauguggaaaagaacuguuaaauuuagcuccuggcccucccaaccuuuuugguaauuuuuuuuucuaucuaucuaacuaacccaucuagaaaucaguugaccaaauuauagacuucugaauguuaaucugcuuucucgguuucaguugaaaacagacuuuguuuugccuacugcagaacuucuagguucuuucuuguagucuuaggggugcuuauuauagaucgaaaaugugagucggcauaauuaagccauucagaaccuuccaaagcagcucacucuugaaaugacucuguccgccuacagccauuuaagauuuaagaacaaaaacagaucuugauuuucuuuuucauguuaacucaagcugcuaagugggagaguuagaaaugauaucagcuccugugauuagucagcugcugaaggaugaguuuuuaaaaauguaccuucauauacagucuauaauuuccagcuguaaaguauuuuagagacugacauuuugcugcggauauuccuucaggauaaguucucagccugguuguuuguuuguuuguuuguuuguuuucugaagacagagccaccaaacgcuaaauuaugcaugucacggagaaaaugaaaagcucugacuucauuguuucuugguucagucauuagcuucacaguaguucaguaacuaaagugcuuagcaagaagagagccgauuaaaccugugcucuacacuggaagaaagcccaauucuuuauacuuaacagcuuucauuuguuaaguuuccacugugggacuacuacaaaaacauuaugagucuuugaugugauuugccacauuaaaaaaauggcacagacaggggugugguggcacacacccucaaucccagugaucgagaggcagacgcugguggaucucuuuauucuuggccaguccaaucuauauaacaaguuccagaccuacugagacugcacaauaagucuucccccagaacccccaucaaaaaaagagcagaguuaggaaggccguacacaagcaggcuugcacacucucacgcgcucgcucucgcgcgcccacacacacacauacauaggcauacgcacaugcgcacacaacuucuuuucucuuaaccugagggugcuucuaaaaucauuaucuuuuugucuuaccuccaguaaaucccuuccugugacugugggaugccucgccugucagccuuccagcuuaaccugucucucucuuccuuuaccauuuuagcuuuaaaaaacaaaagugacaauuugaacuuccugccugcugggccucacccgaaggacugauauugggcugauaaggggauauuuauuuugguugagaggcuugagaaauugcucucccccagaaagcuuucugucacugaccccaucaacaucuccccugauaguguuguccacgguguuuauucuggggcucuggcuuacccaggaguaacugauaacagccagcaggagauaacguccuguaaagcgcuuuccgacuggcaucaaaucccuccagccugucagccuggagaauggaucugaaagcuuuaguucugggcuuccacagaguucaucuucagaccuaucagguagcaagcuuggaguuccuucucaguuaagcccaaaagggcuguuuuauaagagcacaaaggauacuucuuuacauugucuuaagugucauuccaaaccugccagaucuuggaggucaagaaucuuguuucuacuccgagcaugugcaccccccaacuaaugaugcucucagcauccuggggagaagugccuguuugaaugagcaucccagaaacacaacucagccugugcaucggauguguuuuaucuuuggcccaggaaagcugagcugaggcuuuuccugcgaaauagggcuacauaacuauggacaguuuaggacaguauucuccuugucugagcuugaccagggcauauaugcugucucuaggaguaaauguuugucucuuagcugccucugucuucuuuggugcuguaaguaauugaacuagcuugggaaguaccugucgugguuuggcagaggugacugucacaccucaugauuccaggagacagcccagaugguagucugguuagaccagaaccuuggugaaaugcucgcacugccgagcaauggcuagaaggggcagccgccaugcccuucuaguugauacaggcaauucgaacagggcucaugaaguuccuauguaaagagaaucgaguuggaaauugaugacaguucauuacuuaaaacuagucuuaaucuuucaucuaaguuugcacagcauucugauuuccucuagguaaacugcgaaugacuuauuaacccgugacaaccccccacccuguauuuuuuccaccccaucuuagugaacgcucugcccguuccaguuugaacagcacuuuucuauccuaguucucacuaauggaaaggagaucauccaaggggcacugggcucuauggaggcuggcauugucccaggguuugauguuauucccgauccccccccccccgccccccggaggaaguggagcaguguuucugaguggguggcccagagcccucccuccggagugagaggcguuaggggccaggugucuagccuuuguauuugcugcugcucaggguuucucaagaagagagaauggcuuucugauuucacuucaguucuccacagcccugugaguaaccgcccuuucuucuucauuuuagcacaaacggaaagcaacccaaagcaauacaguagugagaaaaaugaacucuacccaaagaguguccccaagagagaguacagcgugaaagaaauucuaaaacuggacuccaaucccuccaaaaggaaggacaucuaccguuccaacauuucacccuucacuuuagaaaaggacauggauggcuuucggaaaaaugggagccccgacaugcccuucuacccucgggugguuuauccuauccgggcaccucugccagaagacuuuuugaaagcgucccuggccuaugggauggagagacccaccuacauaacucacaguccccuuccgucuuccacaacuccaagucccccugcgagcagcagcccggagcagagccuuaagagcuccagcccccacagcagcccgggaaacacggugucaccccuggcgccaggccucccagaacaccgggacuccuacuccuacuugaauguuuccuaugguuccgagggccugggcuccuacccuggcuaugcaccugccccccaccucccaccagcuuucauuccuucuuacaaugcucacuaccccaaguuccuguugccaccguacggcauuaguuccaauggcuugagcaccaugaacaacaucaaugguaucaacaacuucagccucuucccuagguuguaucccgucuacaguaaccuccuuaguggcagcagccugccucaucccaugcucaauccagcuucccuaccgaguucccugccuaccgauggagcccggaggcugcuuccaccggagcaccccaaagaggugcuuaucccagcaccccacagugccuucucccuuaccggggcugcagccagcaugaaggacgagaguaguccccccagcggaucuccaacggcgggaacugcagccacgucagaacacgugguacaacccaaagcuaccucaucagugauggcggcccccagcacugacggagccaugaaucucauuaaaaacaaacgaaacaugacugguuacaagacucuuccuuacccucugaagaaacagaauggcaagaucaaguaugagugcaaugucugugccaagacguucggucagcucuccaaccugaagguaggucuccagacccccgcggguuucugcccacagacccgugcugguuugcccuuggcugccaggcagugcauuguugagugcacuugagccauaggagacccagcuugagccugaacuggggucugcugaauacugaaaauacaggguuuaucucagugucuuuccuaagaggcuugcaucugcauuguacauaccuggcucugggaaacuuagcaggcaggcaggccucauugcaaccccagaguucaccccugugguuucuucccagguccaccugagagugcacaguggagaacggccuuucaagugccagaccugcaacaaggguuuuacucagcucgcccaccugcagaaacacuacuugguacacacaggagagaagccacaugagugccaggugggcaguauucucuggguagaacucuugaccucuguggaaaaauagcuguagaauugucuuccuguguuguuucaacaauacaaaaaauauggucuuguacuaggcugcuggcccugcacagcuccuggguacucugugacuacucacaggcuauacugaggauggcuggguggaugucagucaaguuucaguggguggggacauguccucagauaaacaguaccucagaguacugugugcccagcuucuccccccccccccccccccccccccaccgcagcaugagcauuguuaagaggcuucuggucucccgagguuucuggcuauuggccugccuuuccccuccagcugcaaacaauuaaucuggucuucccugugcccuuucucugucuucccuugcccucacacuuuaggucugccacaagagauuuagcagcacaagcaaucucaagacccaccuucgauugcauucuggagaaaaaccuuaccaauguaaggugugcccugccaaguuuacgcaauuugugcaccugaagcugcacaagcgacugcauacccgggagcggccucacaagugugcccagugucacaagagcuacauccaucucugcagccucaagguccaccugaagggcaacugcccugcgggcccagcugcugggcugccuuuggaggaucugacccgaaucaaugaagaaauugagagguucgacaucagcgacaaugcagaccgucuugaggacauggaggacagugucgaugugaccuccaugguggagaaggagauucuagcuguggucagaaaagagaaagaagaaaccagucugaaagugucuuugcaaagaaacauggggaacggccuccucuccucagggugcagccucuaugagucaucggaccugucccucaugaaguugccucacagcaacccacuaccucuggugccuguaaaggucaaacaagaaacaguugaaccgauggauccuuaagauuuucagaaaauaaguguuucguguugcuucuuaggguauggcuuggugaaucagggugccuuuagcaaauugcuuguacaugacuccagaucugcaaagcuccgcuggcaccgggugcuucccugcaccucucuggaauuaaagaaggacuccaauguuaccaaaaucucagggcauaaaugaggcaaagacucacuauauauacauauauacauauauacauauuauaaauauauauauacuuauuuacagccaugucuauauauuugaaccuguguauuuugaauauuuguguggauauguuugcauagcgccuuccuauuacuaaaacuauugccuagccauaauuauuuuuucaaugauaauucuucauaauuuauuauacaguuuaucuuucaaaaagcaauaauuaaagaaguuuacaaugacuggaaagauucuuuguaauuugaguauaaauguuguaucuuuguccuguggccauucuuuguagauaauuucugcacaucuguuuaaaugccugagacuuagaagauagcucugugauuucaggcaaccuuucucuaugauaaugcuuuaaaaugagguuuugauauugccaaagucaugugguugguguguuaacucagaagaucacacaaucugagugacauucucuaaguuggggauacaugugcagaauugcucagcaauaauuugaggggaaggaagaagaaaaauauuuuauguuucagaaugaugguuugguuuuccuccuccuagucacaauuuuaccaaacagugacaggaaggcuuugccaaccugucucccaaugucacaugaccauucugaguggccauaugacuuuggcaucccuggguguuaucugaaaaugugaagaagauaaaaaagccguguucagaagaucugucguaaagcacagauguuguguguguguguguguggguugggggguuugagucuggcugucauuuugcuguuggcuuguuuuuguuuuuuuaauaucaaaauugcacaaagcuggugcccuaccaagaaggauuugauauagaaaggcucaggccacacuuaaaauacaagcaagcaaagagaacagaaaaaaauaaaaguaaaaacggguauucuuaucaucuuagguuaagcggguaaugaacauuccuguccccaacgcaucaacuguauuguaucuguaaaacucagcuuuucucaguauuuguguuuuugcauuguauaauuaacuuaauuaaagaugaaagggcauugcaaaaguguucaacaauuaccucauugaguguauccaguaggagugcaggaauuaaugucguaucucaugaguugcuacccagcugagcgugugugcuuccaaaugguaggcugggugguucgguccuguauucuccuaagcccaaagguuaccuguugguguucaagguguaauaaagaaugcuguauauuuaugaaccuauuuauaccaguauaccauguguauauaugauauauuuauaaccacuuaaauugugagccaagccauguaaaagaaccuauuuuuccuaagagcaaaaagaaucucucugaaguuuugcuuaaaacuccaugaccucgcuaugacuuuggugcuugggcaccacccugccuacuaccagagagcagagcaccucagugcagaggugaggguguguagcaucuugggauggauagaaacaccacaccauccagucgcauuugauggccuugcuacaugugugucaguugggucacagaauaaaaaucauuuuucuauuucugcucuccucuuccucuuccucuucuucuuccucuuucucucccuccucuagaacccugacucaugcucacugcucagucugaugcuuaccuuagaguuuuguauauauagaucaacuuacaaagagggaaaacuucagauccucugggggaaacccaagagccuuacugaccuguugcugugacuagcuagauggguuucucuuuaccuuccaaggaucaaaaccagagauuccacacaugcuagcaagcaagcaagcugucacugggcugcagccccaacaagacugacauuucuggaugcaucuguauuugagaaaaauacucacuuaauuguagguuaaccaaagcaugaccugacauugacaccaaauacaaauacgauuucuuugcagugaacuuggguuguuuuccuccugugcuuuucuuguguugggaggauuuuuacaaggacaauugcuuuucuugccaucugucuuccucuuaggccucuuacaugagaguguugagcccacaaugaacagugguugguugguugguugguugguuuguuuguuuguuuuuuccucagaguuaaaacugaccaaaguuauuggcuuuuuacuuugcuagaacaacaaacuaucuuauguuuacguacugguuuacauuguuauuuaugugcaaauugucaaaauguaaauuaaaauauaaauguucaugcuuua

SEQ ID NO: 12456 - RNA, 134357 nt, Mus musculus
uggugcccaccccagcgcggucugguuggcagccgucggugcggcggacugacucggcuuagcauccuagcguuccugggcgccggccgcagcgagcucgcuccuucucccggccugugcggggauguagggcgcgggucgcggaggccgcgggcgcggcgggggcuucgcggaggccgcgccgaggauggagagagcgauggagcagcucaaccgucugacgcgcucgcugcgccgcgcgcgcaccguggagcugcccgagggugaggcgcccggagaacgcgcgcugcacuuuuccgaggcuggcgggcggggggagucggcgggaggcgcgggggcgcggccggcgggggcuggggcuggggcggggacggggaccggggacggggacgggcuguccggugggguucgguccgagcggaaaugcguuccgcgggguccgggccccgcacugggaaagggugcgguggcgccucgcacgggcucgggcuggggacgugcuggguuugcuuaagcuacagagugagguaggcgggcuaggauuuauuugaaaugcggggcgccucgguuuuggcacuagacaaagguuggcagccaccagacagguguguuugugcagcucuguugguguagcaggcauuccugcuguagcuugccugccuccaucguuuaguccugcagacuuggguugagugggcugggugagaacucugugugugugugugugugugugugugugugugaauugugggcugggugagaacucugugugugugugugugugugugugugugugugugaauucacaccggaauaaaagcucuguuucgaacuuuugcuuuggcaaacuccaaauagaggagguggggcggggcugggggcguuguuugaugccuugugaagucagacuaauuuuaguggcggugagacaaggcagucagguuuguaacccaggcuggcugcaaacuuuagagccuccugccucagccuuccaagaauuuggauucuaggcauucgccuaccuugcucugcucaguuugcuuuauuccaccuccccccccgcccccccaccaacuucguuuuaguuagcuaaggagagugaugaaaagaaauguggaguuugugaguuuggggauacuuuuuuuuuuuuuuuugaaaaguuuuauucuuuaugauucugaguagagaaaauuuguggcaacuguuucugaguauauauauauauauauauauauauauauauuaauuuguuacuuuccuagacugaaacaauuuagaacaaucuaguuuuaggaaguaaacgucagcuucaacuuuuucuuuauuuccucugugaaucuuuucacuaggggcugcuuucacauauuuccugaugucaugcuaucuauugguaacagcugaugagggcugugugcguagguuauuaacauugcuauuuguauuguuaacuuauauccggcauuuugcauaaauaugauauaaaaggcuuugauaauauuuccugguuuuaaacauuuuauauuuaaauauauuuauauauuuuguauauuuuaauuauagaaagauuugauaauaaaaauaaagaaaaaucugucauucuauucacaauaguaaacaaucuuuuugcauuuuuaccuaacauuuuucauacagugucuuguuuuguguuuagaaaacaucguggauguguauccauaaauguaguuaaugauuuggcaggacuugguaggaugaaugaaacaaaaacuugcuuuuuaacauuuuaauguuuuuacugauuuuaaaagaacagcuuuguccuuaaggcuuagucuucuguuuccuuaggguuuguuccuagaagaugagcaggauuuaauuauacagccgacauuuaaaagaccuuaauuaucaguuucuuaaccuagucuuugggaaguucuggucagcagucugagugcuuggagacuuaaauauuacaauuaaaaauaaaguguuuccucuuguugcuaggcaaaaaauggcauauugcucacaucucuuugauuacacaucuucauuugauuacagugaauuuguucauuuuguucuuugaauuuaccauuguuuugaugaaucuuugaauucucuuaguuuggcucuuucagguagaucaucauguucagugaauucuaaaaauacaaauuauugugguugcacuuuaaggcugaacagagaagcugaugaacggggucaguguguuaaggggccuccccagaccuggcuaccugacuuugaucccuagaccucauguagagacagaaagagagaacugacuacacagcguaguccucuggccuucacgagcaugcuuuggaauauuauuauuauuauauuuuuauaauaauaaaaaagacugagcagaagugcugagaucuuucuaaaauuaagaaauaaccuuuuuuuuuugcuuuguuagaauuuagcagucaacaaauaucuaauuauaauuagaauaaauuguuaaaguauguuucuaaucagcuuuuacaguaaaauuaacauuguuguauagcacuaauaaguagacacuugauguacugacugggauacugagagagccccuuauguuacuagugagugauguggacgagucaucccgcgcagggauaacaaagugugaaagaaaaggaggggaaggcaaagaaauuauguuggagauguggccucucugagucuuagaaggcucauguguauugugcacuauguggagaaaacuaaacuguuagguuuacauugaagguaguuuguuuaauaggauagaauuugagugcauuuuagcauauguguuugauucauggucagaauaacugccagcuuuaaaaacaacagcaacaguaacaacagcaacacuacaucuuucccguuuuguggacauugcuggagcagcagucaaauugaaguucaucugacuucugaccaaagcaggaucuguaaaaagccucucagcggggccuggcaaacacagaaguggaugcucacagucagcuauuggauggaucacagggcccccaauggaggagcuagagaaaguacccaaggagcuaaagggaucuacaacccuauagguggaacaacaauaugaacuaaccaguaccccggagcucuugacucuagcuguaucagaagauggccuagucggccaucacuggaaagagaggcccauuggacaugcaaacuuuauaugccccaguacaggggaacgccagggccaagaagggggaguggguggguaggggagugggggggggaggguaugggggacuuuugggauagcauuggaaauguaaaugaggaaaauaccuaauuaaaaaaaaagcuucucagcguccuuuucacguguggaggaagauacaucuuucccacuuuucagagagcugaggcagaagucugauguucugucugugcccguuugaaaggauggugaaggucaggcuguaagaggacauuacagaggcccacagauugguaaaaggaguccaggucuaccggaaggaagguguggccugcauggugcagugaggaaaggcuaauggcucagcugucuguggccacucacccuagcaaggugggaucaccagguucaugcuggacaaaugcuucagaaaaauccuggaacgaaaagccaaauccugccagguaguaaaggagaacaaauacaaggaagggaugcgaguggagggcucugauauacaacuuucauucaagacugcuuaaggaacaaaauacccuagguuugaagaggaaaugaauguacaguaauagguacacuuuggucaauauagucuucuguugaguaauuuaguucuaaaaccguguaaauaaaaguggucaaccuaucugauuuucccauccuuagaaaguguucuauuuccaccuuucaagguaucuuugugaauguggagaaggaaguaucugagaacaaauauucuuaguauaguauuucuuaguuccuuaagaauuuuuaauuaaaaaucaguuuaugcauauggauauuuuugccuaaauguauguauauucuacacuuuagugcugguggaggacagaagagggugucagaucacuugcaucuggaguuagagagcgugugacucaccaugugggugcuaggaauugaguugagccugcaucuccugaaagagcagcccuuugauagucuuauuuuaacauuacaguuuuauuuuauuauucuuacauuuaauguuugugaucuaucaucucuuuguccauccauccuucugucuauccauaucuaucuuguuugagagacauagggucacuaaauguaccccuggguguccugggacucuauguagaccaggaugaccucaaacucaacagauaucuaccugcuucugccuccuuagugcuggaugggauuaaaguugugagguaccaugccugguugugaucuauaccuuuauaagguuggugaaacuuaaaaauaugagaucccuaucuaaauuuuaauauaaauauaauuaaugcaaauguuuugaugcucacuaaugcuuacuuaaguugugugcuuuaguuuguuuuguuuucuugagacagagucauuguguagcuguggccagccugguacuauagguugguuucaaacugaaggcaaauccucucgacucagccuuucaaaugcugagauuguaggugugccguccugcuaggcauguacugucacgauuaaagcauuuagguucacaaguacagguauuaccuguuucugacaguugguuaugagguuugggauugucaugguuuagaagcuccaagugugagaaaggaugccaugaugucagcagaaacuuaggacaguauuuucaguccugaugauggccggcugguaguuagagacaacaguuuacugaaaugcaaucagcauuuuaaagaaauggauaaaauaauuagacuauaaugcauaccauguauuguuagggcucuggaaucagucacuuaaaugccaacacuacacagcuggcuuuuuagggccaaaauagggaucauagugucuauauuauaaggcaguugugcuauaaagaucucuuauauauggugaugccuuacuggcuuuaguuacacagaaagaauucaaggccagcuuguugagauccagucucacccacaucccccaaaagaaagauaauauguuuugauuauuaaaguauuauuuguaguugaagaauuauauccacauacugaauuugaaauguugauuaacaauugguuuucauguuuauacucacaaauaguaaugaaaugguaauaaguuuacuauauauaacucaauccuauauuucuuaacacauauuuuuuaaacauaaucauaauaccauuaucagcaucaauacaguuagcagucuucuugcuuuuuucuuaauuguucuuaacccgugcaugcuuauuuuucuuucuuucaaaaauguguguuagagcuggggaucaaagccaggaucacaggguuucucucaggcuauguaagcagucuacuauggccagcaucucagcucuucagguugguuuguucaagucaguauucauggucagcccguuauguuuagcugauucaucucucaagauuuaaugucucaggcuuggugugguggugcaugccuuuagucccagcacuugggagguagauacaggcauaucucugaauucacagccagccuggucuaccuagagaguuccaggauagccagggcuguuacacagagaaacccuauuacaaacaaacaaaaaacaaagcaaaacaaaacaagaaaacaaacaaaaagacuuaauaucuccaaaaacuucuagaaauaguuugaacucuguugcacaaccaugugaauauugucacuaguaaugaauggcuuacuugaaaauggcuaaugguauguguguuuguuuuuaucacagugagaaaaauauguaucguaaacaaaagucauuuuuggcuguuuuaggcuuauagaaaauccagcuuucagcaucugguacuaccguaguacaguuaucaaaucuaagaaauuaacaugugcacaauaucacugugaacuacacugcagagucgaugagcguucuagcuuucccacugucaucugcuuuagcauguacuacaggauacucaucacauuuaguuggguucuuuagucucccuagugcgucuucugaucacuguaagggggacugcucauacauuuuguggucucgcuugguuuugucaggugucuucugaugauccgagugaggucacacauuuuggggaguauggccuuuucuguggauuguaggaguuauuucuaaugauauuaccuauuaucugcccauuaaagugcuaggugcugggguaguuacuguaaauuuauucuuuuuccauuguaguuuuuaggagauacuuugguauaagccucaguguuauaaggcuaaguaaaaucucuaaaauaacacgauacuguuaguaauguaaaaaaaagaaauaaguucaaaacacaagcugaaacacaacauaaacgcaauguggcaucucagauacugccuguguguguguguguguggguguaucugcacagaggccacugucuuccauccuguuucugugagauaagagucucccauuggacuggauggguaggcggcaagccuuggcagcugucuacaugucuaauaguggcaggguucgcggugcacgucuaugggugucgggcucagagcucagaucccccugcuuguguggcagcugcucucgcccuugcccacagagaccucuucccugccccgcacaugcugaugcuuaacuuuugaggcacauuguuuguaccuuuaucuagaaauauaugacuauaagacuuaagaauguaaagcaauaaguguauaguucagguuucuuucuagguaaagauauucgucugucugucugucugucugucugucugugucuaugugagugugugguuguguauguguuuggguauggguggccaggagggucagaagaagucagaucaguuggagcuagaguagcugugagcugccuggcaugggugccaggauccagaugcugguucuucccucgagcagcagacauucuuuagcccugagacagcuuucucuucaucuuucuauuuauuuuuuuucuauuuucacacauacuugguuuuguuugucccgcuucccucuuuggccccccaucucccugcuguucaucccugcuaagccuauccuuugccaguguuucuccuuucauuuucauaucauguuuguucuuuuaccaucucuacugcuaucucuuaaaauacccuuuucccuuuuaugggguggugguggugggggguggggggaggagaaaagguguuacagaggcuggucuggaacaauguguaacauuccuuuugccucccccucugggguacugugauacuugguggguagagccaccaagccuagcauauaguuaagauuuuagaauuauuguagcacauacauaucuuuuaauauccuaauauuuaaaauugggguguuaacauuuccuuaauuucuuaagaauuucucuaauuccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauuaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugauacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaaugucuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagacaaugugguacaucuacacaauggaguacuacucagcuauuaaaaagaaugaauuuaugaaauuccuagccaaauggauagaccuggagggcaucauccugagugagguaacacauucacaaagaaacucauacaauauguacucacugauaaguggauauuagccccaaaccuaggauacagaagauauaagauauaauuugcuaaacacaugaaacucaagaagaaugaagacugaaguguggacacuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaagggggagugggugggcaggggaguggggguggguggcuaugggggacuuuugguauagcauuggaaauguaaaugagcuaaauaccuaauaaaaaauggaaaaaaaaagaauuucucuaauuauucuuaaauaauaaaacaugugggaaugaagugucacuuguuaaaguccaggagagacuagcucuccaauuuugucuuauacccacaggcuaagcuuuucuauggcaguguaggaggcauaaacagcaaaggagaugagaaauccuguguugucauggaauuugcaguguguuugguguugugccugucggaccuuuucacuucuguguacagcugggaaaacuaauuguuugugucacuuacuguaaaagcaggagauacuugaauucgguuuguguucguuuuuuuacucagauaaugagacugcuguuuacacacugaugccaauggugauggccgaccagcacaggugaggaggaggcacuugcuucuuagguuugugaugucaugcuuugcuuugcugauuuuuaaaaaauuggauauuuuauuuguuuacauuucaaauguucuuuccuuuccugguuuccccuugcaaccccccacuccauccccccuuacccugcuucuaugagggugcucccccacccacucacauacccacuccagccucaccgcccuaacaugccucuauacuggggcagcaagccuucacaggaccaagaaccuccccucccacugaugccagauaaggccccuuuggcuccuucaguccuuccccuaacugcuccauuggggucccuguucccagucugaugguuggcugugggcauccgcaucuguauuggucaagaucuggcagagccucucaggagacagcuguaucaggcuucugucagcaagcacuucuuggcaucagcaauagugucuggguuuggugucuucaugugggaugaauccccagguggggcagucucuggauggccuuuuuucuucagucucuguuccacucuuugucccuguauuuccuuuagacaggugcaauucuggauuaaaauuuuggagaugggaggguggcccgaucccucaacccggggccaugucuaaccucaggauauggucuccgcuuugugggauauuucagcuaauguuguccccgaaggguccugggaggcucuugcuuuccuggcaacugggacuuucuggcugcuaccccaaguuccccaucccccauugcuccagaccccuguucaauuuccugaccuucuacaucuucuccaucuccucccauaccugauucugcuccucuuccccccuccccuuccucucuuccucccaagucccucccacccucuuugcugauuuuugaacaguguuguauugacugucauucuucagauagacaacuguuggaauuaauaacuguuguaaaagagcucuugccuugauuuacuacauuuuaaaaauauguuuauuacuuauauaucaucaguucuuuauacuuuuuggggacuauaggucuguuucugaacuccuaucaaauucaaaauuugaugucaauuaugcauucggacgugugaagagaagcuugcuucacauugcugcaaaguaagccugaaauaguucacauuacacuccagucuagaguaaggguuggaagcuuuguauccauugccuugcggcagcuauggggaaagaugagagcuggcagcuaaggcugccguguccuguuuagcccuuaaugugcugugcucuucauaaauuguuagcguugauauggaauucaugucucgaguucaugugcucauagcuugcuuuaggugaggcuuagggguugucuagauagguguaguguguguauucaccaacauuucuuuuaccuuaccacugugagggauaaaaggggcaugguggaugcccgaggacccagcaguuuuauaccugggugggaguaucucuuuauccauagucugacacugacugauaccagucuuccuuucaggauuuagguggcaguguugcagcuaauuguucaugauuagcuagcucccggaaagccggaaaguaaagaguauuuguuugguuucuuucagaaacuaauuguuuauuuuacuauauuuuaacuuguguucauaguagaauuuaacauuuugaagguugggguaguucauuuuuauuaugaguuaaaugguagguaaauugggaccuuaaaaaaaauaguguuugauagauuuuguuuguuuuucaauuuugucuacuauggcuguucguugaauguaucugguugucuuuuauauuguucuagcuguggaucuguggaaugcuugguucuucuguugaagaaaggcgcaaacccuaacuaucaagauauuucaggcuguacaccccuucaucucgcugcuagaaauggguaagcuuuguuuucauagugaugcauuaucaggccuggaagcuucuaaggaacucauucuugaucuuuuuuucuucccaacauuuaucuugagaaaaauuacaaaguuguuuuuuuaacuauuuuuagucuuuuaaggauauuugucuacuuuucucuuuaaaauuggucucagauaauuuuauuaaauuugcaaaugauggucauacuuaauaauuuauugaauuuuuuugauaguuuuucuuuuguaaguggagauuuauuauuauauggauauaaugacagucuauguuuuucuuguuucuuucucuguuaaucuuuacauuccuugguuuauaguauaauauaaacuacuuacuauauaauuauauauaauauauaacauuauauaauaguuaauauauuguauuuaauauauaguaauauaauauauaauauguuauacaauuauauaauauaaacuacuugucuaguuuauauuauuaguggaguuaaauuauuaacauauuacacaguuucuaauuguucaagagugaauuguaugacuaauauuucuagguggccgcggcugcuguugcugcugcugcugcucccacugcuccccuuccucuauuuggguuggccaggguuucaaucagggauugguuuggcaugcccacagcaaguagugagaucaagauaacccccucagaggcauggccagagacuucucacacagcugugugaaaaacuuccuaaguaaauguguuuaacggacaauacuaauguuuccaaaaugugaaaacuuagggaugacauacuagguauaucuguuugcuuauuccugauauuucuggucauuauugaccaauaucauuguuauugugugcuauuuuaagcccgucugggcuguuuaugguguuucuugucuuuuucugccacauguuucaaauguuacaucucuuugccuuuguccuguauguugguuagaucuuugugaacuugacccagcuaacgucauuuggauagagaacuucacuugaggaaaugcuucaauuguauuggcauguaggcacgucuaugggaccuuuucugcagauugaaguggaaacuuaaggguucuuuggaaagucaguuguguuggaugguguguugcugugcugcagacccucuuuggucucugguugcagauggacaaggaguuggcgaaugacagacaaaaucaacucaagagguuguguagaaucugaauguaaugccacaaagugaacaccagucuuauacagaaaauaaagggguagcaugucacagcaggcaaaguacauugauguuaccugacacaaaacaaaggaaugacuucaaaaggacucacaggaaccagguagauguuuacaguaaagauaaagcaguccugccuagggucagcuuagugacagguaaggauuucacacccuagucacaguuagugcuacuccuuugagccuugugaaagcuagcaccaggggguucugcucugguaugaauaaugcaauaccacaaaccuccuauuuccuaggccuugauaaauucuuguaugaguguaacuuuuaaguguggagaauuuccauuugucagaagaauucaccaacuugcuuuuaauaugcaauauacccugcuauaccuggcuguagaaaagauaccuaucucagugggauucccuagcucuuucuugguaaacccaccuauuagcuaggucauuguguauucccuuguuuggaugagacuggcuacuguccuaaguaaucacucugcagaccagcccugagcuauuagcucuguucuuuguaaugccuaguuaguuucaccggcucuuccaagcuccuuggcuucaagcauuuucuaggacguuggaacacuggcgaaggcuuagcuaugucagaauuaaaucuuuaaaggcacuuauaauaaaauaauacuaaaagagagcauguggauccauacacuagacuaacgcggggauaggguaugaguauacgaguuaugauaaugccaagguuccaggagguugaguuuuuuucucugaaacucuuugccucgugagugcuuccaggccucuuggccugccaaguagaugucacuggaguguguguaacauucucccccuuugguuuuauuuuucagccgaaguuccagaaugucccgcuugucguagcuacagaucuuagaaguauucuaaagaugaguggaaacacaacaauuacuaauaaaauaaugccaauaauaauagcaaguaggauuauauauugaacccaauccaugggaucaaugcacuuagguuauuuuuuaaaucucuggccaauuuaucaauguuccaaguguccaagugacuuuugcuaauaucugaaaauuuugccuuucuagccuuaauauuugcuauauccuguccuauugcuaagacuacuaguucuaagacauuaaccuuugccuccaauuuuuuaucuauaauauguugcucugacaaagcuauggaaauauuccugugcuuaucauuaacaaaaugagcauuaugcagcugcugaucuaaagcugugguagauaucuuuucaaaguuugcauucccagauuuuuaaaccaaggaucauuuccuaacucuacaggcaguaaaacauaagcaggucucuuuaacaaaaucauaacagcagauuccuuaucuaaauuaggaucuacacaauuaguuaauugacaagaauuacaaugaauaugaaaagacuugccaagauuggugauccuaacucuuaaaauuaucuaacaauauagcauaugggugagguacacaagcuuuuacagcuauaggggaguuggccuaaauggccaaaagcagugucuuugacaaaaucuuguccaauacucuguagcagucccucugccucacgagacaucauuuuuaguuguucccaaguugacaccaggucugcacuccuugcuguagcccauggcggagauaggaaguuucuucaucuuguuugcaagugguugcucucccugauuccucuuucuuugugcgcucaacacaguuuucuugucagggcacucaggaacucacaggucagccugucacauuggaagcuagcauccuccugcagcauucuguggaaaaaccagaaacauugcccccuuccccccauauuaacuuucuguuuaggaucaugccaugugccaauaaguggauccuuuucaucucaccuagacaugauuaugucuaguuuuuaaaaauaaaaaugugggggcagacauguaaaggaguguucuccugaaguggacacgggugaaaggguaaggcagacuugugaagaaacauuuugcugaagcagauacaaaugaaaaggauguuuugcuaaagcaagcaugugaaaggacaugugaugaaggauucuucgccaacaacaugaauuggucugcucuguaguugagcucgauuugucaggacucuguaaagaaaugcaccaaaaaacuucuagugguguguuguggcuuuuuccugcuccagcaaacuugggcugauuggcagagugaugucaggugauuuagacccaugugcugaggugacgaggcaagaccuguggaggacacaugauguuuggagggaguauaaaaaggacuugaagggcagugacagaggcuggggccgagcuuggcuugcuguacagugcuuauuggucuccaguccucacuuaucuuugcugagaguggcacagcugagaacuuuccuggcauuccuguggcccugguuccuccugcugacuggugcugaggcugaggccuggcugucucugcuagguagugccaccacugcugauucuuguuugcuauccugacacuacugagcaggacugcugguggauccaugaaguguugugaguggaccaggcugccacugcugaccugugaacugacugccgauucccagacaacacggaugggagcugcuccaaagaacucuucuaagcagguucacccccaccccccaugcuucccacuaccucugcuggguguaggccagaagggagcuuaaagucuuucagagccaucauuagcaauaaggcuugaaaaacuuaauuacagcagauaauccuggguuauauaagauauaaaugauaccaaaauaaaccaucauuuuaguagcauuccuuaauccagugcgauuuuuauaagcauagaucauuugcuuauuaagaaaauaaaaaaucaucucaaaguuuuuugaucuaggauuugaggaauuuagauuuauaaaucuuuuucaaagauuguaaauuuucucuguuagucuacuuuccuguuguguaucuuuuaauuaaucuuacagauauuuuuauuuuccgaucaggcauuguauguaauugaaguggccacauacaugaaauggcuauggagauaacauuauccauuucauuagcuugaggcuaauguuugcauagaaguguauauauugaaccaaggagauagugaaccauaauuaucucggguuggguaggagaaaguuguaguauuugggcuaaggucucuuugacugucccacuuaugagugagccaguuuaacucugcacuaacugguaaaucaccauguaccaaguaagcaaccaugugaacauuagguauguuguugugugacacaacuguuaguuacuuuuuagauauaucgauuauauuggcaggauaaugacagaucuuucuugaaugguuacauaucuuacaaugcuuuugaacaguuacauaggaaaggacaacuuggugcaggggagggauuaaagaguuccuuuagacgaaguaugugaggaccaaggugucagacuuaaaagacagaauggucuuguucuucuagagagacuguucaaauauagugcuucugaaauaaaggccuuuuaaggagaacauacaaaguacuuuugaucauuauugucaacaguaauugaaaagacauuagcauuuuaaagauacagaaguagggcagguaaugcauaauucacuuagcaaucagcaagaugaaaaggugcagacaauguauucucuucuuagaugccuuucuuaugucuaccucuuaugucuaccaagaauacuugugacagucaguacuuaaauauucuauuuucuauugcuuauugaaugguugccuuauacaauauggagguccuuacuaaguguuugcuaaaugacucaaguauucaguacuucuggaaguacugguauuuuucaaaauaacuuuuuauggggccugcaagguggcucuccagguaaaggugccugugaugaagccagaugaccuacguucaauccuugguucccaccugguggaaaggcaggagggacuccuacaagaacugacuuucagaggcaggccauggcauacacacacaugguaaauaaacaugcaauaaaagcaaaagaggccuugaaggagguuuucuacuuuaauaaccaggcagugguggcacacaccuuugauucuagcacuugggaggcagagggagacagagggaggcagaucucugauuuugaggccagccuggucuacaguuccaggacagagaaaccuuaucugaaaaaacacaagcaaacaaaaacguguuuuacuguaauugaaguaugaaaucaaauuuguccacaccaaaguguaaguuauauaagaacuuuguccuuuuagcugguuuagaguuugguuucuuuugcuucccucaacuguuccugucagguggacaguguguaucuguuggccuguucuaucagauguacaguguauaucugccacggaccgagcucagucggccccccucaauccgugggaaucagggucucggacagaugggcauagagucggcgaaaauggggugacaaacagucaggacacaagggagugugcugaaucugaauguaauuugucaaaucgagcaucaaacuuuuuauacagacgaaaauagggaaguuaggugacacaucagcaagguacaaaugagguuacuguaugcuuaaugacucuuacacaaaacaggaaagcaaacacaaagacuggcaggaacugggcaauaaagcaacugagacagagucagcucuaucuaaggucagcuauagucuuagaagucaggugugagaacuuuucacucccagggcaagggcuuucaugcccaagucaugguucuaauuagggaguuucgcucuagcuaaccuucucaugaauaaugcaauacucuaaaaccacagcccaaucuacuuccuaaaccauuguaaauuccuguauaugggagcaacuuggcuuuuauucuaagugauaguguggggggacuuucuacuaauaaguaauguagucugccauacauaacuauaauaagaauuuuaaacuuacguugcuaagcuugcccugagauuucuaacucuauguaguagauaguaaagccugauuucuuucacuaucucucuuacaauacuagaggcaauucugaauguuacugaacaggcaacauucuuacugaauuccaagcucaaggacuaccuagggcauuggugaaggccaggaagcaaaguucgauuuugcuuagguauuuggcaagucauugcuuggaggcaccuauaacaaaacaauacugaaaggaagcacacagauccauucgcaaggacaaaauuggagcaugcgcaugcuauggaaugccacaguuccaggagacuaaguuuccgugaaacucugcgucaggacugcauccaggguuuuggccugucaugcgugucacuacuggaguggauguagcauauaucuauuggcuugcucuaucagguggacaguuuauaucuauuggcuugcucugucagguggacaguuuauauccgucguaucauaggcauugugagcuuuuggguuaguauauacguagugaguacauacaguguguguucuuuugugucuggguuaccucacucaggaugauaauuucuagguccaucccuuuggcugcgaauuucauggauucauuuuuuuaaauagcugaguaguacuccauuguguaaauguaccacauuuucuguauccauuccucuguugaggggcaucuggguucuuuccagcuucuggcuauuauaaauaaggcugcuaugaacauaguggagcauguguccuuguuacauguuggagcaucuucuggguauauacucaggaggguuauggcuggguccucaggcaauauuauguccauuuucugaggaaccgccagacugauuuccagucugcaaucccaccagcaauggaggaguguuccucuuucuccacauccuugccagcaucugcuguuaccugaguuuuugaucuuggccauucugauugguguaagguggaaucucaggguuguuuugauuuguauuucccugaugacuaaggauauugaacaucuuuuuaggugcuucucagccaugugguauuccucaguugagaauucuuuguuuagcucuguaccccauuuuuuaauaggguaauuuguuuuuuuggagucuaacuucuugaguucuuucuauuauuggauauuagaccucuaucggauguaggauugguuaaagaucuuuucccaaucuguugguggccuuuuggucuaauugacaguguccuuugccuuacagaagcuuugcaauuuuaugaggucccauuugucccuacucgaucuuacaagcacaagccauugguguucuguucaggaauguuuuuccccugugcccauauguuugaggcucuuccccacuuucucuucuauaaguuucagugucucugguuuuauguggagcucguugauccacugggacuugagcuuuggacuaggagauaagaaugggucgauuugccaucuacauacuaaccgacauuugauccagcaccauuucuugaaaaugcucuuuuuuuccacuggaugguuuuagcuccuuugucaaagaucaagugacuguaaguauaugaguucauuucugggucuucaauucuauuccauugaucuaccugucugucacuguaccaauaacaugcaguucuucucacuacugcucuguaguacagcuugaggucagggauagugauuuccccagaaauucauuuauuuuugagaauagucucuccuauccuggguuuuuuguuauucuagaugaauuuggaauuuguucuuucuaaaucuaugaagaauugaguugaaauuuugauggggauugcauugaauagguagauagcuuuuggcaagauggcuauuuuugcuauauuaaucguuccaguugaugagaugggagauguuuccaucuucugagaucuucaauuucuuucuucagagacuugaaauuuuuauccuacugaucuuucccuugcuuaguuagagucacaccaagauguuuuauauuauuugugacuauugugaaggguguuguuucccuaauuucuuucucagccuguuuuauccuuucuguagaggaaggccacugauuuguuugaauuaaguuuauauccagccacuuugcugaaguuguucaucagguuuaggaguucucugguggaauuuuuggggucacuuaaguuaauguucauaucaucugcaaauagugauauuuucacuucuuccuuuccaauuuuauuucuuuuaccuccuuuuguuguccaauugcugugucuagaacuuuaaguacuauauugaauaguuagggagagaguaggcagccuuaucuagucccugauuuuagugggauugcuucaaguuucucuccauuuacuuugauguuggcuacugguugcuguauauugcuuuuuacuauguuuagguaugggccuugaauuccugaucuuuucaagacucuuaucaugaagggauguugaauuuuuucaaaugcuuucucagccucuaaugagaugaucauacgguuuuucuuugaguuuguuuauauaguggauugcauugaugaauugccuuauauugaaccauacccgcaucccugggaugaagccuacuugaucaugauggaugaugauuuugauguguucuuggauuuggauugugagaauuuuauugaguuuuuuugcauugauuuucauaagggaaauuggucugaauuucucuuucguuguugggucuuugugugguuuagguaucagaguaauuguggcuucauagaaugaauaggguagaguaccuucugcuucuauuuuguggaauaguuugaggaguaucaguauuaggucuucuauguagguuugguagaacucuguacuaaacccaucagguccugggcuuuuuuuuuugguuuggagacuauuaaugacaguuucucuuucuuuaggggauaugggacuguuuaggucauuaaucugaucuugauuuaacuuugguaucuaucuagaaaauuguccuuuucauccagguuuuccaguuuuauugaguaaaggcauuuguaguaggaucugaugaauuuuuuuugaauuuccucaauuuuuguaguuacaucucccuuuucauuucugauuuuguuaauuaggaugcucucucugugucaucuaguuagucuggcuaaggauuuaucuaucuuauugauuuuucucaaagaaucagcuccugguuuggugauucuuuauauagcucuuuuuuuuuuuuuucacuugguugauuucagcacugauuuucauuauuuccugcagucuacuccucuugggugcauuugcuucuuuuuguucuagagcuaucaagccgcuaguguaugcucacuccagcuuuuuuuggaggcacucagaguuuuacucuuaggacugcuuucauugugucucauaaguuuggguaugcuguggcuucauuucauuaaacucuaaaaagucuuuaauuucuuuauuucuucuuuaaccaaguuaucaaguuguucagcuuccacguguauguuggcuuucuauuauuuauguuguuauugaagaucugccuuaguccaugguaaucugaugggauguaugggauuauuucaaucuucuuguaucuguugaggcccguuuugugaccuauuauauauauggucaguuuuggacaagguacuaugagguggugagaagaugguauauacuuuuguuuuaugauaaaauguucuauagauaucuuaaacccauuuauuucuuuacucuccucuauuccuauuauccuuagguuugaucuucucauuguguccuguauuuccuggauguuuuagguuaggaucuuuuugcauuucacauuuucuuugaucuuugugucaauguuuucuauggcaucuucucuaccugagagucucucuucucucucuuguauucuguugaugaugcuugcaucuaugacuccugaucuuuucccuagguuuuguauuuucagaguugucuuccuuugugauuuuuuuuuuuuauuguuucuacuuccuuuuuuagauccuguaugguuuuguucauuuauuuuuccuguuuggauguguuuuccuauaauucuuuaagggauuuuuguuuccucucuaagggcuucuaccuguuuaccuuucuucuccuguauuuuuuuaagggaguuauuuauguccuucuuauaguccuccaucaucaucaugagaagugacuuuagauucauaucuugcuuuucugguugugaugguguauccaggacuugcuauggugagagaguuggguucugaugaugccaaguaaccuugguuucuguugcuucuguucuuaugcuugccucccacuaucauuuuaucucaagugcucccugcccucguuauaccugauuggagcuuguccuuccuguaauccugguugagucagaacuccucagaguccagcuuuuucugugauccugugauccugggauucugucauccugagauccugggugugucugaguucuuggcagucaaguuuccucugagauccugagauccuggugugaccaagcuccugggauccugaaauucuaagauccuggaugugugagagugccuggaagugguaccuccucuggggggugguggggcuguccacugaguucgaaaccaagguagaccagugccaacuggaaggaauccaagccucugguugggcaggcuuccugugucccugcuccugcuggccccagguacucauggugguauuggaacagauguuuuguuucacuuaccaaugaucguaagauccugggcuagggcaccuggggaguggagaguccuuuguggaccauaggacugucagcagaguucgcuuccaaggucguuuucacugaauucugaaaggucuuuaauuucuuucuuuauuucuuugcugaccaaguuaucauugaauagauaguuguucagcuuccagguguaugugugcuuucuguuguuuuuguugcuauugaagaccagccuuagucuguggugauccgauagaauacaugugauuaauucaauguucguauauuuguugagguuuguuuuaugucugaguauauggucgauuuuugagaaaguuccaugagaugcugagaagaagguauauucuuuuguuuuagggugaagugcuauguagauagcuguuaaauccauuugguucauuacuucuuuuaguuucacugugucucuguuuacuuucucuuuccaugaucugucaauugcauccauucuuguuuaaaccauccacuauuagagauuugagguuacaugauauacuuuaugcucauaacugauauggguagaaaauugauauugcaucagcagaaagaaaaugugcuguguuuuugcaugucagcaaaggauugaccuguucauguucuacagagaauggaaaucggaagugaaaaaguuuuuguauuucaaaauauggucucaaacauuuuguaauuuuuacuuaaauuguuaggaggcuuggaguuauuaguuuaucuauuguccaaugcuguuuaguagagcacugaaaaaaaugauacaaguugucaauggaugagugaucaacuaauagcccuucuaguaauugauuuauuuuucuacaauaaguuacauaaaccaaaaaacauaaauuauaaguuaccauauauuuguagguuacagauuggucaauuuugaaacuuuugcauuuaaaaauauuuggaggguaaauuaugaguucauaaagagcaaaauaguuuugcucaguauucuagcaguaaaucccagcaaaaaagcugcucaguuguuggguuguuugagauugaggaaaguaguaguaguauguauuaaauaagaaagguacaauagguuucuugucuguguugcccuguaccuuuagcuuuuugcuuuuggaauugagagcauuacauggguacuuuuauucaaccagccuaccuuaaagcuuuucaugucuguuuuccuggcccauuuugacuggagcgcuuauuuuggagcuaggcuaaugaucuacauuggcuucuuaauagucuuaaaauucccucuguauggacacaguaacagcccaccuugggaacaguguaccuucaucauucccacuccuuugcuuccccuccagcucuucccagcccccucaccaaguucaugagcuuuuaguuauuguuacacguauguacuauguauguauaauacauauuugcauguguauaaugguaucuaggacuggaucagccuaaagggacauuuaugagcagacucagguuauuguguucauuuugcuuugcuguguguuuguucagugcugaccacuugugaucucugugugagcucaucucuguaggagacugauucucucucagcaggcauuucccaccugaagcucuucaucuaagggugagacuguguggacucccugucccauugucauguuaacugguguuagcauuauccucuucuuuuuuaggcaacauauuauugagacucauagauuuauuccuugagauauguggaauacauugaauacauugucgcacagcaaauguucuggucuuaaagcuuauauagucuuucugcccugguuuuuucccuaacucagagauguacgaguuuugcuauguauguauccauuggaguuggguauuaaucacuuaauagagccgucacauguguuucuuaugauuauguuuauuaugaauuucuaagaucauuguuauaauguuuuagauaaacuucguaaauauuggaacuucaauauuuauuaucagcuuuauuuuccauuucuuugaguguaauuaagauuuuuaaaugagauuuaaccuuguuucaagugcaaaaaucaaaaugagaaaagcaguuguuuugcagugcuauuuauuuacuuacaaguugaaugcuuauuaauaaucaguugauaaagcuuuauugagaauuucaauguaacugguuauguuugucacuugauuaaacauauaauuuaugacauaaagcuaauguugaacuaguugcuuaaauauauguuaugugcuauauauacuauauacuguguuagguauauuacuguaugauaauacuguuaauauguucuauaauacauaacaugauaugcuuuauuaugcuuuagugaauaagauuauuacuaacuucaugucagagguuacaccacaguuugucaauucaguacugaauauauauuaguuaucucugcuuuauaauuugauugccguaugagggauaugaguagaaaaugaaccuuucuuaaguaugugguucuauacuuucaggaaucuugaacagguaguauaaaugaaggugaauuuaagauaaagaccagauaguagcuaggaauggaucaguuggaaaggaguuucaugagcaaaaugaagugggugggcaguucugcagugcacagaagacuuaucaggaauuaggaaauggaacaagcucccagcucuacuagaaaauaaugauuaucaaaaaccacaaacacaaaacaagccauuggcuaggauguggagaacguggaacacacguagguagcagcguaaagugguaaagcugcugugaaaaacagugagauagugccucagacacuuacaaauaggauugcaguacgacuuagccuuuucacagcuagauauacucaagagucaaaagcaaggugcaaaaagcacucacugcauauauaucgacauuguguauaauggugagauguggaaguagccgggcacccaucaggugaugaauggaugaggaaaauuugguuuauacaaauaacagaauuguuuucaauccuaagaguaaagcauuucugauaugcuaaaacauagauaagucuugaagacuuuaugauaaguaaaauaccauauagaucuguacacguaaaaaugguuaggaugagcaugccuuuaguuucagugcuucagaggcagaagcagauuuccaugaaguugaggcuagucuggucuagugaauuccaggccagccagccagggcuggguaaugagaccccggcucagggaaucaaccaaccaaccaaccaaccaaccaaccaaaaaugagacauuuuauguuagauguauuuuaccacauaauauaauuauaaaaauguggguagagagguguacauauauaugcaguuuaccaguucuccgauuauguauuuuaauccuccuggagagugaacccagggucugaagcgugcuaagcaagugcuuugucaccauguuauacucacaaccuuguuuggguuacaguuuuucuuaguauuuuaaacauuuuguaaccaaaaaaguagagauacaacauugugguauuugcugugucuauugcuaaugcauuaaauguauauguuuuaaaauucaaaugaagauugcuauuccauuuaguuagccaaagcuagaaauuucuaguaauuugauuugcuuaauaaaguuaaaaauuccucagcaaucugaaggauuuuuuuuucccaaugaaaugaaaaaaaaaaaaaaaaccccaacaacaacaacaacaacaacaaaacccaaaauagauugugucauuucuuuaaucuguuauuugagucauaaaaaccguuuuguauuuuauuucagaauaguauauauacuggagcuaguuugaaauuuuagagagcacuauuauaaaaugaucuuuguaguuuaauguugguucuauuuaguauuucggugaaauagcuguuauuguacauuuccuaucauaguuaucuguuacugucuuuuuuucuuuucagacagaagaaaugcaugaguaaauuacuggaguacagugcggaugucaacauuuguaauaaugaaggccuuacagcaguaugugugaucacuuuucuuugagauuaaaaagauacucuagaaaaaauggugacugugcugcagaugcaaguuguaaucccagugguuuuuugaguuacaucuguaaagugcuugugagguauacagcgaguuuauuaagaaacgugauauccucguucaucucagcucuucuuuagguuacuuucauuaauuuugaagccuuauucuucuuguuuugucagugacuuucaagggaguuuuccuguuaagguguauuuccagcuggguugggcaugguggcacaugcggggcaugggcagaggugggggcggggcagguugggcuucaagugcuaggacuacauagaaaccaaaguuaaaucaaggggagaaacaagagcugguuuccauuaugucuuuuaaagagcuguuguuguauguauuccagggaaauuguaugccucuguagagagggucaaaggucacagggagugagaauucacuguucuuuguacucagauaacgacuguaaacauccauugcucuuaaccauuuuccaugcagaacuaaguuaguauacuuuugauuuacauauugggaaaugguauuggaaucuacugaaaggauuguuaaauagccucaaaauuuuaaucaaauaauuaugauuuuuuuggaguauuuauuuuugaaguagagguaaaauagaguaaugugaucaccgaguagcuaauuuggagacauagcagagggugcuaugcacaagcauagcagauguaauuuguuaaauugaauuuaaccuuccuuugguaacacuuguagguuuuuuucuuucucucuuucucucucuuucuuucuuucuuucuuucuuucuuucuuucuuucuuucuuucuuccuuccuuccuuccuuccuuccuuccuuccuuccuuccuuccuuucuuucuuucuuuuuuuaauagauuccaucucaucauguagccucagcucaucuagaacuuucuauauagacccugcuggccuugaacucgagagaucugccugccucuguuucucaagugcuaggucaaaaguguguaucuuugccuggcauuuguagauuuugcaucuuguauuuuuguggauaaagaauaauauugaauaccuacuuauuaaacugguuuucaagacuuuuuuaauuaaaauuucuuuagauuuuuugaaguaagaucuuguauaguccaggcuggcauuggaccuaugacaguuuccuugccucagcuccugagugcugggauugcaagugugucucaccaugccuggcacauauauauauuauuauuaauuauuauaauuuuuaaauauauauaauuuuuugauauaggguauaagagaaaguuuuccucaguuuucaaguauagggugggcuuagucauaauuauuauacaguauuuguaauuccugugacaguccagauuuuguauauauuagcaguauuguagcaucuauucuguaagguaaucuugcauucagaauacagauugccuagagaugugggauguagaagaguuauaaaacuuagaacugacacagaucuuucuguaguacagcaacuugaggcaagauaacauguucacugcuaucauauuuucauugcauaauuuccaacugccaacuuuucauuccugagcuuucaaggaagauagauuagaaaauauuuuauuuugugauuuugcacggcuucaguguggacucuuggccuucuuucccuuaauuuuuuucuacuucaaguuucugucccucuuaggaaaugcuuuucaguuuuguaacaguuauauauaugccucuguaguugaauauugcaugguaguaaucuuucucguuucagaugugaccacauuacauuuuggagcagagucuauuccuucuuuacugucuuuccucucguuucuucauguguaagcacacuucucaugucugucuaacacaaucauugcaauuuuaguuaacuuuucaaaaucuaguuuugacugacuaugauucauaucuaucccucuuuucuuugcagagcauuuuguucugugguuaaugauuaccuauaaaauauugagguaauuguagacuauaggcuuguaguagacaauauguaaaaauccuuuguauauauuucccccaguuuuccuaagcauuuuauaaaauaugauccugcaaccaggauauggauauaguucauuuuacugagauuuuuccaguuuuauuuacauguguguuuguaugaauucaauucugugcacuauuacuugugguuuaggugguuaccauuacagucauaguaugcagauuuccaguaucacaaagaauuuuugccaugcucuuucacaugccacguucaaccuucgacugccauucucuccauuucuaaauucugucauuucaaggaugcuaauuagacggauccuacuauacugaaggcuuggcuucuucugugcuuauucccuggagguucaucuggguuguugugugcaucaagaggguguuccuuuauaaugguggauggaauugcaugguacaugggucaaccuucucaccuguuaaaagacauuugaguccucuggguuuugggcuguuaugaguagagcuaauauaaacauauauauucuguuuccuuaggauaaauucuuuggaaugaaguugcugcauuugugcuugcuuuuaaagcacacuacuaacugcugucuacacugaguaucuuuucauaagcuuauuuuccauguaccuuacaccuguccuguccuguccugguauuuucaagauaggguuucucuguguuucucuguauaguccugacuuuacuggaauucucuguagaccagucuggccuugaacuuagagauccaccugcccucuugaguucugggacuaaaagaaggugccaccauggcuggcauauauaucacucuuaugugaaaugaaacaccaguucauaugugucauaguugggguuuuauugcugugaaaagauaccaugaccacgacaacucuuauaaagaaaccauuuaauuggggcuggcuuauaauuucagagguuaguccaugaucauuauagcaggacguggccaugugcaggcaaacaaggugcuagagaaggaacugagacuucuauauaucuugauccacaggcagcgggagacugccacacugggcauagcuugagcauaugagaccucaaagcccaaccucacagugacacacuuccuccagcaaggccacacuacuccuacaagaucacacuuuguaauagugcuacucucuauaggucuaugauaauuacaaugauguuaauuacauucaaacuaccacaauauucuuuguccauuuucuaauuuuuaauguucaagaaugcuuuauuggcuuauuuauuuuaaauuuauuuuuaauauauguauggguauguuguuugcuuguaugugugaauacuaugcacaaucaagucccaaugaagucagaagagggcacugaauccccaugaccugaaguuagagacaguugugggcugccauguaggugcugggaaucaaaccugggaccucuggaagagccgcaaguacucuuaaacauugagccaucuuuccagccccaagagucaugcuuuauuauaaacuucauuugcaaguauuuucuccaaaucauugguuuggcuuuccaaguacuuaauaaauagggucuucuuuuagagacagucucauuauguagucuaggcugcccccaaacucaaaauauuccugccucaaccucccaggugcugagauaugacaggugugugacaucagggugggcuaccggggugauaugaauaguaaaaagcuuuaauuuuggcauguuuuccauuuuauauaccacacuuuucuuuuuaggaacuuguugccuagugcuagguauugaaaguuuucucccccccacccccgugaaaguaucaauauuuuuaguuuuucuacaucuucauuuucauuuaguguuuuuaugaguugugaugcucagguugcggcucacuguguuugccugugagugaauguucaguuccacuagaaccauuuguugaaagguuauaaucugucucuaaucuauauauguacuuguagcugggagggguggcgcacgccuuuaauccuagcacucaggaggcagagguaaguggauaucugaguuaaggccagccuggucuacagaguuccaggucagccgggaguacagagaggaaccuugucuuacaaacagacaaaaucuguauuuauuccuucgugaaacuuguuuugugucuucuucaaaaaauggguaugcgugugugguccucgucugggccuucucgucauccugcugaugcucgucuaggcuugguauacauucuguugcugugugcaugugcuucuuugccuguaccacccaggcuugauuacuguaguagguguaauuccucucaucuuagguuuucuucaugaagacugcauuaguuauugugguuugugccuggagaaguacuugcuaggauauugacugaaauuacacucagccaguguacucacuuauguaggucuuugauuucuuccauuagcauuucauacuguucagcacagggacuuugugugcuccuguaagcauauaacauuucuugucuuuucauuuucuucagggcaguucuaaguguuauuguuucucucccuccccuccccuccccuccccuccccuccccuccccuccccuccccuccccuccccuccccuccucuggauuugugcaaaaauuagaaaaaauauuuugugugugugugcacacauguaucugaauuguaugugugggaguauaagcuuacacuuguaccauggcauguauauagaugucagagaacgauuuuggggaauugguuccuacccucuaccuuuugaggcagugccucuauuguuucuguugcuuugcagcaugugccaagguagcuuacggugagccuccagauuaauugucucugccucccauuuuuuccuaggggugcuaggauuauaaauguguauggccacauuuugucuuuuuguggcucaaacucauggucuucagcuguuacagcaaguauuuucacucuaacuucuuggcuuuucccuugacuuaugcaaauauuguguguguguguuauuauacuugcugaacuccuaauaguuucuuuccuaugacuucagugacauuuucuacauagauaauauaauuuguaaguacagauaauuuucucuuuaaaucucaaaguuuacuuuuuuugaugucuguucucauuuugauguuguuuguuaugacuagcuggucuuugcuacuuuguugcuuccucuuuuuccuaccuucuauccccuuucagcccccaacacuagauaagagagaaagaaggauagaagauagagauagagauagagagaucccugaauauacuuuuuuucucaacugcaccucccaguuuccagcucagucccuucaaagguuuccccaaaccauuccucccucaguuucccaacagucugcuuaaacagucucgucucucauuuuccccaguaguagccucuccaaacuauagcagcuguucuagccuaucugcucagcuuggcuucuccuggcucagcugucuucuaacaaugucuucugcaccaagugacuucuuuucucaugcuauuagccuaauucacuuccagaugauuguucuucccacuagacuagccuaauuccuaucuucacuugagcuggcuuaaaaaaaaaauacuguucccaguaauacaagaggcaacuaacacugaaggucauagggucaaggaguucuaucagcuaaggauucuuaaagauccauuugacuaacaacuggggaaucuuuuaaaggaucagacacacaagauaaaucacaaugguauucauauauuaucugcguauuuuauuuauuuuugagacagucucuuucucaguagacagacuuuugacuacucuguggguucauuuucuuccgucuuuccucaccucuuuucucuuuucaacccccuuauggggagaaaaagaaggauagaggggcguguaagagaaagaaacccaugaaaaaagucagggguagaaaagggguaacugcuuucugugaguugggggcgucaaguuccuugggacgaguuugaucucugccaucaggauagcuaaguucuuuuugucucuuugcucaugauuacuugacaaauuacaaccaacaguaaccaacaacauucaaccaucaaccagccauccagucacaacugucaggguucuagcauuuauauauccucugaaaaguccuuagaaucccaaaugucacacacuugcaaaacugccuguagcuggcaaaaucaugcuguguuagagcacuaggcuaaucauagaugugguuccugagcaggguacucaagagccaucccggcugcagcagguuacuccuuccuccccagccugcagcuaugaugccaccucaggagcugucaacauggcagcuucugucaaaacacccuugccuccauccugcugcugucaugaggagcaguccacggugacagcaccuccuugaguaguuccauagagacgaugccuuagccagagcugccuguggccagaaaggacuuauauucuaacccaugcucugaugcagggaaaggaaggugaaaaaaagccaccaauccccgagcuucuuacacaaccccaccaauuccugagcaugagaacucaccaguuccugagcuccccaagucagaacuugaaauccuaccaauccucagucuggaaaucucugcccaagaaauccuguacaagcccugcccuuuguucaguuccuugcugucugucccagggagcagagguggacacuucugaauaugucccuccacacuguggacccuucaagugucuuguaggagauuugcugccugguguaacucucaucugaagaagacaagaagcaaugacgagaagugaagagaaggagcagggcugaggaugcccuucuccugggagucguccuccccugagagcugugugcuuccugggcuuccacguuccaggacucccuuccaucugagcaggaacuuacaauagucacccucuguaaagcacccacaccucggauaaaacaaaaacauuccuacaacauuuuguguuuuaaaagaaaccaaauucucacuguucccucccuucguccucucuggccuguuuuuauucaucuuucuaaaugcauuccgugucuuuuauguucuuaauaaagucuugauggagugucgucuagaaaugugugucuucugcaugcugaguugauuugauucuagguccacugcuugguauucggaguguuucuuauuccuucuccuccucaucacaguagagauuuccaucuuccuuuccugcacguaugcuugugugagggugucccauccucuggaacuggaguugugagcugccaugugggagcucagcauugaaccagguuguuuggaaaaacaggcaguauucuuuaccacugagccaucuuucuagccugggagcacaucuuuugauaguuuacugaggaaaucauuuagugguaauuuuuuuuuuuuuuuuugcuauccuguauaucugaauuuggcucugaauuuguuauuuuacuaauaauucacaauaaaauucuagguuggacauaauaguuuuuccuuagcauguucacaguguugcuuugcuguguucugguuuucugguuuuuacuugggugccauuuuguuucuugauccuuuauaugaaaccugguuuuguuuguuuauuguuuguuuuuuuuccaaaaaauuuuuguaaucuacuuugucaugagcauucuaaaauuucacgauaugucuuguuuguauguuuuauccauuugcuucauaaugcccagacaguuagcauagaaacccaugcaaugggaauucaggacaacacuacauuaauuuugauuuugaugauuucuucaucccgucuguaacuauuacuguucggauauuaaaccucucagaugggucaauuuuaguaaaguaccacuuugcuuucuacuguuucuccacuucuuucugugugcuuuugggagauuucuucaacauauucuucugaguuuccuuuugaguuuucaugucccuaucacaauauugauuucugaaaaauuuuuuugcacuuuccuuugcaaaaauuaguauaacauucuuuuuuuaaaaaguacacuuguuguggguccucugagccggcagcgacacgaaugacacagacacgggucgcggaucggguucacgcagcaaugucuuuacuucaggcuuuuucuuuuacagcucucuuccccagcagcuucuucuuagggcaagggcuaaccuacucucuucauuacuacuggcuucuaccuagggcaagggcuagaaacuacucuuauucuacuucuggcuucuuuuacaacagcuagcuucuaccccuuacaacagcagcuucuacuacuccauccuucucgcagcaagggcuaaacucuucucacuacuucuggcuucuaccuagggcaagggcuaaaaaccaacugacucaccuccuucuagcuccaccccaccucauucaaucagaauucacacacacuccaggcaagagcuuaggugguucacagauaggcugacaggucuggaucacgaggaacaguccagccuggcaggcagcccacacaugcagccucacugcgcaugcucgggcaaggcaguaaacaaguggguuucauggggccugcggcugcacccacuuuccgcauacgcuuaguuuuuuuuuuucucugagaguauuaaaauaaguuuuucauuauucauaguuauauuuuucuuucacuuuucgguuuuguuuuugcuuguuuuauacgcugucauucaaauuaaaugcauaagaaggcaauuuaagagcccugucugcauucauguuuauuuacuagaggcuucagaguaggauggucuguuuggauauuugucugugaaaccuucccuuggcauugcuuuccuuagguuguuaacuuuugagccagucccauuccuuagagaaacugucaggaagauguuagcacucuaggugcuggcuagagaaggauguaagaggcucaguuuuuaggauuuaaacuuguauucaaucuucuuuuaaaaauguguuaugugcucuugauuccaugugcuuauuuucuguaauccgcagaucucuuauauucagcuuucucuuaauauuucgucagauuaaugagggguuuuuccugucuuuguaaaguggacaagugauagggauccaagagucucagguuggauuaaacaaauuuucaacagagggguuuuuaguuccaucuuguaauccaagagaccuauacuaauuaccgauucugaagccuuugagggguucuguggucuaaaucaaaugccuucuuuucuuuuuucuuuuaaauuucccuuuaaagacuuauuuguuuuuauacuauaccuaucagaugauuuaccugcauguauguaccauauguaugccuggucccauuggaggccagaagauggaauuggauccauuggaacuggaguugguuaugagccacguguggcugcuuggaacugaaucuggagccucugcaggagcagcguauguucucaaaaccccugagccaccucucuagccugcucacaugccgccuauuuacuuagcuuugcucuuacgugcuuaggauccugauuuuuguucugacaugacaacaaauauuaucuggcaagauggaauguaaugccugcuuucuagccuccaaaacuuccauuucuuccuugucuugaugggcagguucuuuaaaaaacugcucuuucacuguuaacuuuagagggauugcaguuaagcugauaaauguaaucagucuguaauuguaucuuaauauuuguaauggaaaaaucaaguaaaaaauacauacuucgucugaaauugcuccucaccccauuuuaaaaaaaaacuuuuuauugguucuuugccccuccccucauaccugcccucuacccuugcaaccuccuccacaacagaagaaagaaaaucucauuguggaagcuguagugugucacagugugucucacaguguacucuuuuguccacacuguuuugcuugcaaauauucguugcaaugauuccuuggucugaugggucugacuucuguuaguacuggcaccucacugggccuccucucagauacugugugucauagagauccuguuguuuuggaucugcaggaccagccucuucaugcacuccagaaguucauugauggggaagauguuggggugggccuacucaaagcccuggauaugcaccugagaggugucugagcuggucagccugccagcucuccugcucucaugcccucagggcuggcucaccuguaacuaccucucucccccugaacaggcucugcccuacugugcugccaggugaggggcagggcccguucucccaagugcuguagcaggugaggggcagggccagcucuucugcucucaugaccccauuggggccaucucucccuccuuaaugucacuacucagcagacagcaaggcugacucucgcucacacccucgggcagcucacuugcaacccccacguccagggccagcucuacugugcuguccaggugaggugcaggcccacucucuggagugcuauaguaggugagggccagggcuccucaucccagauuuuaaugcugaggcuuggacuuggagccuucuaugugcuaagcgcaugagccauaagagugguucucagccugugggucaugaccccuuggagggcugcauaucagauacgcugccuguccuauuagauuaugacucacaaccauagcaaaauuauaguuaggaagaagcacaaaauaauuuuaugguugggggucagcacaacaugagaaacuguauuagacggucccaguguuaggaaggcugacgacuacuguggcaucguacuaguuucugugcugccugauuauugccagcuugacagaaagcagaaucacuuguagcaaagcaaucucaguuaaggauuccagcacauacucuuuaccaccacauccuugcuccagcuccaaaaguuucuuuuuccucccuucccuuucuuccuuccaaauccuucuauguacccccucccuaguauucuucaaaucuguggccucuauuuucauuagguguuacuguaugcauguauguguagguauacacacauaugcauguaucaguauccauuuaaauauucaaaaugauccugguggcagcagugcauucucuggacucccgaaugaaagacauaaacacagaccuuacauuuuuauauacugggccacuuuuuaaccuccauguuaauccaccucccccuaccccaauauucccaagucauuucuuacuaaaaucuauauuuuuaucuuuacugcccaggacccagaggcggcuaagcucucugacccacgucuucucaggugcacugucucuucuccuccaccuuuuuccagcaugauggcucuccucccuucuuccucuguuccuugcccaggaauccuaaaagucccuccuauguucugcccagcuacuagcugcuggcaacuuuauuuuccaauaaaaaccaacuggggcagggucccucccucaguaucuugcggaccuguggauucucuugcaauuuuggggacccaaauuaccauaauauaagcagcauuagaccaaccccccaauuuacauauaugcaugcaacaacaacacacaugcacaaaaccuguugaguccauuuaauguuguacguauguuuucagggcugaccauuuggcguuggacuacuuguauugguggacuaccuuuacugcuucucgcuuuaccccgcugucuguauuucuuugugugugguugagguccagcauguguuugauuagugauuaauauggagugugcagcccacugcagaugguaggccggggcuguauauaagagguaggcuagcaagccaggggaagcagggcaguaaagcagcauccuuucauggccugugcuugaguuccugccuccagguuucugccuggcuaccuguccugacuuccuuuagugauggacugugauguggaacugaaagccaaguaaacccuuugcauuucaaguugcuuuagguagguauuuuauuacugcaacagagaagcauuuugagacaugcuuucucuguguagcccuggcuguucuggaacuuguucuguagaacaggcugccucugccauuccagugcugggauguaagguguguucuugacacugggauucuugucauuuaggcuagacauacauguacuguguagcuaagauuggucuugaauuugcugaucugccugcuccuacuuaccaagugcuaggauuacaguuuuguuccauccagcuuccucguuuguuccuaguuggaaauuucuaauauuaucuuuuaaugguauagguuuuuauaugucuuuuaaaaaugguuaaaguuuuuauuauuaguguaggguauauugcuauuuauaacuacuauaacuguguuguuauauauauauauauauauauacuucuuucuuggaaaggaagaauacuaaccuauuuucucuagcaauaagcuguuagaggccagggccuucuaagaagcagaguaucuggugaccuaagccugggauacuuacuguauugaguccuuugauucuugauuuuauaauauauggugguguagccaacaucuugaugcauguguuuuucucauguaaaagcacggaaaagcuauuacaguauuuuuaguuugaauguugugcucaguagagaaauagcacucuucauauacugacuuugaaugaaacugccuuacacaaauucuaauaacaaaauggcuuugcagauacacuggcuggcugugaaugggaggacagagcuccuccaugaccucgugcaacacgucacagauguggauguggaggaugccauggggcagacagcgcuacacguagccugccagaacgggcacaaaacgguaaaguucuccaugaagauguuaagggagugcauguauuguuuuaaaaguguuugaauucaugauaagacuuauuuuccauauuugggaaaaugcuacauuauagugaaauacuguuuucuauuuuguauggacuugugaugagcauucuaucugggcagagggaauaguaaauagugcuuuugccuuuguucaaaauaguuauaauuuugauguuauuucugauucuaguuuaaauaaaugacuacauuuuaaaaucagugugucuuuacauguauuuuaagcaauuauguuuaauaucaguuuuaacaaguaucacaacauuuuuauuaaguaucgguaaggcgaauauugauacugcuuuuuaauguuuucaguuggguuaucauaguuguuuucuccacaugauggaaguaacuuucugucggcacauuucuuuugcuuuuuuguuguucuuauuuuucuaccucccuuccauccuuauuccacccuaauuccaacccucagcacuaggcaggagagaaagaaggcuagccggaaagggguugugggucucuguuggccaacaaaauagaccacgacuuccugcugauuaggagaguuagguuccuggggcaaguccagucuuugucuucaugguaucuccaacuuccuucuuuugucaaacugugacagcagcaaccaggagcugcaggacaucagccuucauaggcacucuccagaguccccagaauuuaacuaucugcagcuggcaaaaaucacacuucugcuagugaccuaauucaugaggcaaguuuuauucacugcugugaagcagccuuuuaucucauaccugagauuaaaacaaaaucauauucauacaacauuacugggcucauaaaggaaccaaaguugucaguaguuuguuagauuucuguaacccugccuuugucccgagauguuacuuuccugucacugucauguagacaguuaacguggugauagcuuuuucauuaggagauugcugcuuuguauaaagauggagagcauaaggucuuagauugccuuucugacuuacuguauuuccuauucuguuuuuguugguuuuucuuucacauuuaaucuugaugauagaauauaaucucuuuauuugcuaaguaaccauaacaauaccaaaaugagcugaaaacaaaagucauuaucaguaacaaaaaagugcuuauuuguccaugugcauauagguacauacuuuuauuuauuuuauuuuuugagacagggacucacuauguggcucuggcugauagggagcucccucuguagacgaggcugaucuugaauuuacaguaauuaccuuugucucuugagugguggaauuacaggugugaccacauguucaguuuacacagugguaaccucucagucucgucuauuuuguaaggcaguauugggauuuagaucucucucucucucucucucucucucuuucucucucucucugugugugugugugugugugugugugugugcgcgcgcgcgcgcccgcacagccuugaguguuacuccuuaagcuaccauccucuauauucuuuuuuuucauuggccugaaauucauugaaucgcugagacuggcuggcuuuucagcccaagugaucugccugucccugcuucccaagagcauggauugcaagcugugucaccucaaccauuuguuuuucauaguauacuggccuccuuuaagacggugaggcccagguugauuuguguuuuguaagggcuggggaagagggauguaagaccuuuucucuuucuugaaauguuuccugaacaccuccauuccucugaagacuuuguuuuguuuuuaucauuuuaaagagaugcaggcauuuccuuuuuuaguucuuguuuuucucuguauagcccuggccauccuggaguucacuccauagaccaagcuggccucugacugagaaaucgccugccucugccuccugcaugcuggggcuagcuaaaguuguguacuaccaccaccuggcccaagcauuuucaaguaguauuucuucuuacuaguuuaucauuucuuucauucuuucaucaauauuauuggauuuuaaaaauaguauauaugaauaaaaugaagugucuuaauuugagugacucagcuuucuccccuuccuuugugacaccaaagcucaaaugcaaggccucauacauguagugcucauugcuugagcuguaugcccagucacagugagcuagggucuacaggaacuuacugcauauuagaaagugaguuacugauagcucccaagagauaggaaaaugauacauggaauguuacuugcuaauacuuacaguucuuaaauuuguacaggaacugcacguuacaauuggaaguaaucacagaagcuaacuuuggcuguuugaagcuaauauaaaacaagauuuaauaagaaaacauugguggcuguccuggaacuugcuuuguagaccaggcuggccuugaacauacagagguccaauuaccucugccucaucagcacugggauuacaggccugugccacacugcacauggcuaauguauuuguauuuuauagaacaaaauauaaaacuuuaagggauaaagaaacugugguaaaaaucucuuuaaaaaucuuaccaguuauuucaaauuaaagacacuaaaaucauaauuuaaagaaagccacugaaauuugcuguaacuuuauuuuagaguaaaucucaggaguuuaugaaaagauuuugaacgaaugcccaagaacucaaaagccuuguggaauuugcaaauaaauauauauucuugccuuuuugacaagaaauacuuuuucagauucauacuaauuuucuagaagauaaaagaauuggaaaauagguuccuucuuuucaugauuaagaauuugggcugaaguugaguuggcucaguggucaggcacaaagccuuggauuugguucuuagcuccaagggggcaaaaaaagaaauuggcuauacuuuguuaugguuaccuacaguaaccauaagcaguauagcugcugcuuuacugaggguagguagugaaguuucuuuaucugacuagaagaaagugcuuggaggcagugcauuuuggcuuuuguuguuugcucuuuaacuucauuguuagaaauaauagauccuuguccacacacaaacagaauuuacuaagauuuuuuuuggccaaguauugaacuuacuuuuugguacauuuuuucuuguuaucuuuaagauuuauaaaugugcaggagugccauaaaugauagauuggugaacuuggauucagaaaacucaugaacugucagucugaauauacauguuauauuacauugaggguuaaacuccaaacuguaacuuaguucauaauaaguucuacuuuuaaaagaguaauuuuuaaucccuaaauuuauacaacuuaauauguaaagcuucccaagcauuauaaaacugcaguugaacacuuguuuggguagauuuauauuaaaucuuaaaaacacugugugccgcuguugcuguacgguugcacuuacagacuugcugggaacaauggccacuucuguucuguuuguucucuugguaucuuaagcccacuucaaguuuuccucuaguuaccuacacaauuguaaaacauuaauccaauugugccuugaggcauacagguaaacaggcagauguuucagaauauauuuuuauguucagagugauuuuauuuauuccagugcuucuggaaaaugugaacagaugauaaaaauaccuccugauucuuguuuuccuaacaccauagugacuaguaaugauuuuuguaggcugucacauaacaggccagagucuagagguuuagaggguaggcuuguacggaagcuaugcaacucaucauucagaacgaagcuggcaaucuuucuuuacauauaaauuacuuuucuucguuguaauucaucauucaaacuauuuaauaaaaaggaugcuucuucugggcgguggcggcucacaccuuuaaucucagcccuugggaggcagaggcaguuguuggugguccaagagucaccccacaaaccucacguaucucagucagacagggauaguuuauuuagcauucgccccaggacugacugaugaugccacagaccagacucagggauugacugugaccacgagccaaaauccggcagagcuuuaaagccugaaauugacaaacaucugugccaaguuauucuaccagucaggaucuaggaauaggggacuuccuuaggaacaugcguuguugugugaaauauuaaaaaucaaaccagcuagugcuggcauuggcagguucucacuguugaucucauauuccagaaacugaauggaaccaccagccuugcgguugcauaucacaauacucuuuuuuuuuuccuuauaaaaaacaacauuuaauuggggcuggcuuacaggcucagagguucagucccuuaucaucaaggugagagcauggcagcauccaggcaggcauggcgcaggcagagcugagaguucugucuucauccaaaggcugcuaguggaagacuaccuaggcugagagaauuaagcccauacccacagugacacaccuacuccaaccaggucacaccuauuccaacaaggccacaacuccaaauggugucauuuccugguccaagaauauacaaaccgucacauuccacucccuggcccccauagacuuguccaaacacaugagucuggggugggggggggcauacuuaaacauaguguaaugcaaaaugcaaaaucaagacucuuaaagcuuaauuaaccaaucagauuuauguaucaauaauaucacaauuuacaagaagccaguacaauaauuucagaaccaauugauaaugauaaaaagcuuuaucccaauuaaucuaaccuuauaauaccacaacuauuuguggcugguaaacgccauguggguucauauccgcugccaucuuccuuuccccccuauccugagaugcucccugucucugcaacucuuaguuccaccucccuuuucucuguccaaucacaggccucugcuacacuaauguaauuggacagggaaaauccugcaacaaacauguuuuugugguacauuuauccuauucacauugguuuggguauccaauuguggcaaggcacuugcuuugccuaacauucaugucuugccuaccaggauaggauuuguuuaacauucaugucuuauguugccaacugggaugucaguuauccauguacaugaccuuuuugccaaauagugugucaauucccagggaggucuugggaacuuaaaacucuaccugaccccuacucaaaauggaagucuuacuccagauggcuucuuacauuggugcaagugucuuucuucaguugggguccaucccacaaccagcuucuaaaagcaaacuccauaaaagcucaugugcagcgcaggaagugcugcugggugguugguucagguccaagcuuuguauggcuaacugaccucuugugauugaucucaaagaacaccaaaucacagaacauaacagaauaugcaaucaacucaggcaugagaaaguuuccuaguaauagcaguaacaguaugcgaagguuagcuagacaugcaacacuuaucuaggccuuaccggcagucagaucucuugaguucagggccagccuggucuacagagugaguuccaggacugcuagggcuacacagagaaacccugucuugaaaaauaaaaauaggaggaugcuuuuaaggugguuuuauucacuuuuuguaaaugauacuauagcuuggacguuugugcacagcuuuacuguuuuacaaucuaaucagugucauucugagaguuggcagugauaaagcagagcucuuugggauuucugugaauuguaguuuggcgguauauuggguacagguggucucauuaccacuuucaguuagcugagauuacauguuaguguucuacuuaggguucuuggaagauuaugaucuguuaaaaauguguuguugguuuuuuuuuuuugguuguuuuguuuucuuuguguuuguuuguuuuuaaggaucuuuuaccaugugaaaaucuuucuauaaaaagaagggaucuauguuuguaggaauucaggacuucuagcagaauuuuuuuuuuuuuuuuuuuacuuugggucuuaccaugucugccucauguucuggaaaucacuauguggucugggcuggccuugaacuucccagcaaaauuuugauuuuaaaaacaaaguugguauguaugugugugcgugagagcaugaguuguguaugugugugugccugagaacaugaguuguguaugugugugugcaugagaacaugaguuguguaugugugugugcaugagaacaugaguuguguaugugugugcaugagaaugugagguguguauaugugugcacaugagaacgugagcuguguaugugugugcaugagaacaugaguuguguauaugugugugcaugagaacaugaguuguguaugugugugcaugagaaugugagguguguauaugugugcgcaugagaacaugaguuguguaugugugugcaugagaacaugaguuguguauguguguguacaugagaacaugaguuguguaugugugugugcaugagaacaugaguuguguaugugugcgcaugagaucaugaguuguguaugugugugcaugagaacaugaguuguguaugugugugcaugagaaugugagguguguauaugugugcccaugagaacauaaguuguauaugugugugcaugagaacaugaguuguguaugugugugcacaugagaucaugagucauguauuuguguggaugagaucaugaguuguguaugugugugcaugagaacaugauguguguauguuugugcaugagaacaugaguuguguaugugugugcaugagaacaugagauguguauguguguguacaugagaacaugaguuguguaugugugugugcaugagaacgugagguguguaugugugcccaugagaacgugaguuguguauguguguguaugagaacgugaguuguguaugugugcgcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguauuguguugugcaugagaacaugauguguguauguuugugcaugagaacaugaguuggguaugugugugcaugagaacaugaguuguguauguggaugugcaugagaacaugaguugugugugugugugugcaugagaacaugagcuguguaugugugugcaugagaacaugaguuguguaugugugugcaugagaacaugaguuguguauguuugugcaugagaacaugaguuguguaugugugugcaugagaacaugaguuguguaugugugugcaugagaaugugagguguguauaugugugcccaugagaacauaaguuguauaugugugugcaugagaacaugaguuguguaugugugugcacaugagaucaugagucauguauuuguguggaugagaucaugaguuguguaugugugugcaugagaacaugauguguguauguuugugcaugagaacaugaguuguguaugugugugcaugagaacaugagauguguauguguguguacaugagaacaugaguuguguaugugugugugcaugagaacgugagguguguaugugugcccaugagaacgugaguuguguauguguguguaugagaacgugaguuguguaugugugcgcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugcaugagaacaugauguguguauguuugugcaugagaacaugaguuggguaugugugugcaugagaacaugaguuguguauguggaugugcaugagaacaugaguugugugugugugugugcaugagaacaugagcuguguaugugugugcaugagaacaugaguuguguaugugugugcaugagaacaugaguuguguauguuugugcaugagaacaugaguuguguaugugugugugcaugagaacaugaguuguguaugugugugcaugagaacaugauguguguauguuugugcaugagaacaugaguuguguaugugugcgcaugagaacgugagguguguauauaugugcgcaugagaacaugaguuguguaugugugugcaugagaacaugaguuguguauaugugugcgcaugagaacaugaguuguguaugugugugcaugagaacaugaguuguguaugugugugcaugagaacaugaguuguguaugugugugcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugugcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugugcaugagaacaugaguuguguaugugugugcaugagaacgugagguguguauaugugugcgcaugggaacaugaguuguguaugugugugugcaugagaucaugaguuguguaugugugcgcaugagaacaugaguuguguaugugugugcaugagaacgugagguguguaugugugcccaugagaacgugaguuguguaugugugugcaugagaacaugaguuguguaugugugugcacaugagaucaugagucguguauguguguggaugagaucaugaguuguguaugugugugcaugagaacaugauguguguauguuugugcaugagaucaugaguuguguaugugugugugcaugagaacauaaguuguguaugugugugcacaugagaacaugaguuguguaugugugugcaugagaaugugagguguauauauaugugugcaugagaacaugagcuguguaugugugugcaugagaacaugaguugugugugugugugcaugagaacaugagcuguguaugugugugcaugagaacaugaguuguguaugugugcgcaugagaaugugagguguguauaugugugcaugagaacaugaguucuaggaauugaacucggguuaucaggaugcauguccaggacguuauccacugagccaucucucugucccugaauaucucaacguuuuaaagcgcuuacuugcuguuguaauuucgacacacaaaaaugacuucaguuuaguacaguuuuuaaaguuauauuuguuaaauuaacuuuaaaauguauggguacccccauacccauguacauaugauuagaacuaguuagacucagugguuauauuuaaaaaagaaaaagaaaaaagaagauaugauguuggaggggauuauggacaggaagaguacagauuauuaugaucaaaauucauuguguacauggaugaaauuuauauuuuaaaaauguauagguaaucauuagauauuuauguugauauguuuuuaguuguuuauguuuuauugugagcugcugaacuuauuauuauuuuuuauuuuuugagacauguagcucuggcuguccuggagcuuacuguaggucaggcugaccuugagcucaaaccucgaacucagagauccucuucccuuggccucccaagugcuggacuaaaggcaugugccacuaccaccuggcucugaacuuaguuuuuuaaacaaguaaacaagaagcuguguaaugugaaaaugagaaauuaugaucaucauugcaaauugcagcuacauguuuuagaccuuuuauggcuuauagcucaauacagacaguuuucaugaaggugcuugcacguagaguuucaaggcaaggcacucuaaaauaaaugaaagagaauucugauuuauuuucuggguaaaacugaucagcacuuaucgugcuauguguuauuuguuuguuauaucuuagucucucuuuccucgguguaauauaaacucaugaaaaggguuuuagcugggcguguugacacacagcuuuaauuccagugugcaggauguagaggcaggaggaucuggaguuugaggccagucuggguugcauagugagaaccugucucaaaagauggcauuguguccuuuuuuuuuuuuuuuuuuucuuguaucucugguauuuaaaauaguuuauacuguggcuucacuuuuuuuuuuuugaggguauguauuuuuauguguguaugugugugugugugugaguguguguguguguguguguguacaccuguguacgcgugugugcuugcgugccugcaugccugaaguugggguuagguaaucuucuuuaaucacuauucaugaggcagggucuuguguugaaucuggaccugcugaugaugccagucuagcugucuaguuggccacuuugccucgggagucccacaucuaacugcugacugcugacauucagguagcugcuaugcacuuuuguuuggguuuuagggaauuacaacuugcuuagcaagaacuuuauccacugagccaucucucuaaucccuagcaggguuuguuaaauucuauuuacaacgucuuuucaaaagugugagaaaguuuuauauaaccucuggcauaucauuacauaaaacaguuuuucagaauugaucaacauauuuuguauuauaaccaauguugagaaugcugcuuguauaaauaaauaauacacgugagagaaguauguuuugggcugcuucaaaauucaucccaggucaaaauuaacuuaacuuuuucuuuuaaaaauuaagccucgaaaagacauuccuuuuuuuuuuuuaaauuuuaauuuucuaugugugaguguuuugccugcaugcauguuuguguucaugugugccuagucccugagaagucagaagagagugccagauccuguuuauagauaauuguaaagugcuacuugagugcugagauucaaacuugggacaucuggaagaacuagugaucacagucacagagccaucucuccaacucauucauauguauauggauauaugcauacaugcauauauauguguguguguauauacacauguguguguauauacauguguguauauauacacacauacauauauguguauauauucaugucagcaacucuaaaaucaaauuugaaaaucaguauaauccaaaacacacuaauuugauacugccaugcugaggaaugguuauaagauaauauuaaaauuuuaaaucuuuguuuuucauaaugaaacuaucauuucuaaagagcagagaaauuuguauguucaacaaaaacacuucaguaguucauaacuuaguugucuugaguccgagcuagaguucugugugagguggagcaaugacucuuguagugcauggcguguuccgaacaaagccugcagggugugugaugcaagugcccgugcuuccaggagcagcucagucacuacgcaguugauuuugaguuaauauucagucagugcacauucagaaauuuuauuguugccaaauuuuucaugauucccuaaauucaaugaauaugcugugagaaagaguuuuguuuguuuaagauggaacgucaaugagaggcauuuguccacuguuuucguugcauuugugaauacuugucauuuucucccuuuguaucuuuaaguggaguguguguauauuaguagcucuauuucuacaaauaauucugauuuguuugucugcuuaaaaaucuuaugguuugagaauacuuaggacuucaaaaaacugaaucaaaaauuauucuuaauuaugcugugccuuauugguaugacagaaacaucuuuaaguuguauugcuucaagagccuugauguacugauuaauuaggugcaugcucagagaauguauucuccccccugagcuucauccauucugugcauacuagcaccuuuacauuguuggaaacauuuguuaaauuuuaguauuucuaagacugcauaccaucuugaaacuuguguuagaaaggcugggcagcaaauucuucaguguaauuugauguagguuuuauuuuccaugauguuucacgucuagaucaggagagucuuguuuuuaagcaagaaaguaguugguuguugcagauaggccucugcuuuacuaguggaacuuuuauuguugcuuuggaucaucugggaaagccuugggcuuguguauugaaggcauggcaagggcuugagucaaaggcuugaggaaggcucgcuucccgucagggcucugaacuggaaggugauggggagccuugugcugccucuauuggggagccuugugcugccucuauugucuugagcacuccauaauucccuuaggagcugugacuacaguugccugccuuucuugcugcuuuuccuaugacaguguggaaucaacaguagaaugaguucugucauuucccuuccuguuuuagagcuuucauaaacguauaccagcaugcaauugaaaaauucagcgguugaugacuuuucugguuucuguuuguagccaagguuguucuggaacuugcucuguagaccaggcuggcuuuaaacucacagaaauccaccugccucugccucccagugcuggaauuaaagguaugcacuuuucagucacuuuaaugcaguuuaauacaauuacaaaaggaauauuuuuacauugagauucuuagcuauacauuguuuccauuuccauuagagcaaguaguuucccccuauucuucuguaggcaacauuuaccuacaugugaaaccuuaaaauuccuuaauaguugcaaagauugaggaucuuaaaaaaaauagauuuaugguuaugagcugccuggugugggugcugugaagugaacauggagcagcaguaaaaguucuuagccacucaacuaucuuguguuaaaacaggaaaaaggaccuaccuagauggaaaggaaaaugcuagaaucaguugcugccacuaucuuaaucaagucucuuuuaucagcauuuggcaggccaugcaagcagauggcacguacauaagaaagagaauuuuaaugucugcaagauaugugagaacauugacaauucauacuguaggucauguuuuguugcuaugauuuccuugaaguucgucugaccgcuuucuugaaaauacuaaaggaauauuuaguuugugguuaaauuaguuuuauccugaaagcucugcaguauaacugaaaacagaaagcacuguaaaaaguggaaugcuuuucaaaauggcauuauuuaaaaacaaaacaagcuacaguuuaagcuguaguugacugcuuuauagauucugguaaggauuagggcaucaguacuuucucuuuuuuauuuuuauuuuuuuauuuuuugguuuuucgaggcaggguuucuuugugcaguucuggaucucacuuuguagaccaggcuggccucaaacucagaaauccgccugccucugccucccaagugcugggauuaaaggcgugcgccaccacugucccgcucguacuuucuccuuuaauaagacauccugacaaaaagcacccgaagggaacaagugguucauucaguuuacaaguccagguuacaccauugccucagggaggccuuagcagcaggagcuagagccaugagcucacacucugcucugugccggagcagagcgaagugaccagcgcagcuugucagccagccagggcccagccugugagccggagccuucaguauucaggguguguccuccuacaucaguuagacaguccauccacuacagauacuuccacagacaagucucuucccaccucauucuaacuuguggcaaguugacauuuaaaaguaaauagaacauucuauaauucuuaagauaaaacuguggaguaauguggauucauaaaaauuggaauuucuacuuuauagagaaaaagcauacuuauuuugaucaugggcuuaggguuuuaauaucuguuuguugugugcuggaguauaaauuacuugaccuuuuuggaauucaauauccuguguacagaaguggagucauuaaauuuauugauacgugcuuaucagcacagcaucaggguacauguuaagguuauucauaucauuauaccaucucauaguuuuagcuauaauauauauauuauauagucuguguuuguguguaaguaguaaauuuuaauacuuuagcuuuuauauuuuuaggucugagcugcauaugaaccuuuccuuucuguaugggguuuugccugcauauaugucuauaccguaugcaugccugcuguaccucauugucucuaggacugaacuuagagaugguucugagcugccauguagguacugagaauggaaccuguguccucuggaaaagcagccagugacguuaaccacugagccaugucucuggcccugaaaaugugcuuucaguguacuugcuuuaccacuccugagucuugugggagauuaaguucauuguguauaaguucuguaauagcugugggcacuaauagcagccgacuguaauagcagugcccguuucauuccugcuuugagaccagaugcagcuaacuuuuggggacagaaaucugaaaagugaaaccaggauuaaaaugcacauauaugccuuuuuuuuuuuuuuuuuuuuuuuugaaaaacagggacccaaauacucauucuuaguccuauucauccaugcucauguggaggccagaggaggaugcugggucgucauuucuuucuccuuuggacuucugugaggccgagugccuuucauugaguuugaugcucaucaucaguucagccaagcuggcuggccacuuacuuuauccuuggguuccuuccugcauauguugccaugccugccuuuaugugagugcuggggauuugaacucaugucuucuugcuuucacagcaagcacuuuuacccacugagcuaucucccugggaauuggauaggagauaccaucguuuucuauaaucuuuaauuuuuucugcugggaacugaaccuaggaccuuguauauacuaagcacacaccuaaagcuaccccguccccccguccccccgucccucgugcgcgugcaggccguauguuucucuccuauuagguaugauuucuaaguuucccuuagucucuguuuguuugcuuaaaaaaaaaaagauagcuagaacugagcuuuuuagaauucaaaaauuagauuuagaauucauauugagauauuaguaaauucaggcagcaauauaugacagccuuuuaaaccuuucuuuuaaaucaagacuccugaagugguaauguucaaguuuuaaacuuuccuuugguggauaucuucaaauacuaagucgcuauggcuguuuuucaaucuuugacccuuguguauuucuuuauggguuuaaacauuuucuuuaggcaauacuuacacauaguuagguaaauucuuuuuuuuuuuuuuuuuacugaugagucaacuuguaagcacuuuuuaaaaaauacauuuuuuuauuagaaaacguuuuucaagcaauauaguaugaucauaguuaacccuuucccauccccucccaguccuucccacuucuccauaguuuuucuuuuucuuucuuuuuagaaaacaaaugugcaaacaaagcaggauacaaaaauugaaaaacaauaaaaacugaagaaacacacacacacacacacacacacacacacacacacacacacacgcacaauccauaaaaacacaaaauuagaaacugucacauagaagcaaaagcccaguaaaacaaaacaaaacaaacaaaaaaccccaaacaaaacagcaugauucugcaagucugcaaaaugaccaggaguucauucuguguuggucaucuucuuucuguguuggccaucuucugcuggcugauguggggcccggccucaaguauguuaguuuccucagugaaagucuuuggagaaaacugauuuuuuucuugcaugcaguuguaaaugggagauagcuucuagguuaggggaggaagcuugugugaacuuucccaacuuagugcuggggccccaaaugccuugaaccugugcaggccccauguaaugcugccauaggcuugugaguuuacaugugcgacagugcuguuguguguggaagacgcuguuuccuugguggccucccucucugcugagucagccuuucuaccuguucuuucugagcccugaggggacgguuugauaaaggccucucauggcuugggcagugaacacucuugaaauuaguaauugacuuccucugagguuuuuuuuuuuuuuuuaauuuuugguuuuacuucugguguuugugugguguguuguaugauguguuguggguguguggguguaccaccauguacauguggaaaccagaagagaaguuuguggagucagguaucuccuguaccaguaggcucuggacguugagugugggcugucaaggcugagccacuuggugagcucaauuuuuuucaguuuuauuuguguggucagcaguuuuccucauacguuuccauagcauugaaacguucuugucuacagagacaaguugguuagauagucugccaauucuguuuuucuuucccucaaucuggauaauuuguaaugucuuuuguauucaauuucuuauauuuugguuucuauauuaucucuuuuuuguuuuaauucauucuuuugggggaggagcaaagguuccccuauuuuuaccuucgacacaggauauuucagauauuaaaaauuauuagugcauuugauaauauauuugaguaguagcaugagugacuagagauuuaguauuuggaaauaauuaaaaaacuagaaggcuuuaaacaugauuuagauucuaauguuacauuuaugaaguuuaauguuugucugauuucaggacaugucugagaucuuacauacuuccuccuaaaaacuuuuacauggauauugcuuuguugaaguuccuuaaauguauucagacuggaugcuugaugaguuguucagaucuggcucuuuaugcugcucaguucugggcagccuugggauuagcucuugacaucugugugaugccaugccugucugcucucaauuucugcagugagucucucuguauugauucacugaucuucucaucuuauuuucuguuuauuugcuauuucugucuuguugaggucccaaauauuaucuuucuaaauguuaguuggauuauuauuuuuauuauaaaauucuaaauuuucucauuuucuaaauauuuuucuccucacauuucuaccccuguuucaugguuaaaauacuccuuucucccuuuuuaaagauguucuccuuccuucuuccuugucugccuuccucccuccacccugucuuuuugagacaagguuuuauuaugugguucuggcugaccuccaacgugcuuuguagcccaggcuguccuuauccuuggaaugcuguauuagcccccgggaggugagguuguaggcaggcaccacccugcccagguacuuuucuaaauuuuuuuguauggcuccuuuauuuucuauauuacucugaguuuuguuuugauuugauuuucuucucaguguuagagguuugcuuuaguuguaucuuaaauauuaucuguucacucauuuaguaaugagauaguaaggggcaccaacuggggaacauuguauguaggaugaauuacugccuggcuuagcuguacaccauuggcaguaguggaacugucuguauuuuggacucauuuuuuugggggugggggaggugggagugcuguccugcacaugauagaauuucuauauucccgaucuuugcucaauagcuuaccauccucucuucuguaguaaugaaaaucaaaauaucuccuggcauugccaaaugcucccuguggcgaaccuaacugacuuaguaugcuccuagacucuuucuucucucuccuuguguggguaugcacugugaucuuguuauugacuaagguuuagugcaucaguacgugcgguugauccagaguacuacuaaaacaauuuaaucuugaagcuguuuuuuuaaaugucuuuauauacuuuucuucuucuucuucuucuucuucuucuucuucuucuucuucuucuucuucuucuucuucuucuucuucuucuucuucuucuucuucuuuucuccuuuucuccuuuucuccuuuucuccuuuucuccuuuucuccuuuucuccuuuucuccuuuucuccuuuucuccuuuucuccuucuuuucuccuuuucuccuuuucuccuuuucuccuucuccuucuccuucuccuccuucuccuccuccuccuccuccuccuucuccuccuucuccuccuucuccuccuucuccuccuucuccuccuccuccuccuccucuucuuccuccuccuccuuccccuucuccucccccuccuccucccccuccccccuuccccucaaaugaggccaauaggaauaaaacuagaaaacauuauuuuugaguuuuuucccgugggcuuuguucuauccugaaucucaaacauguauuuuuaagauuuugugugaaugcacuuuugauaugagucagaugacuacaggggauaggguauauaugguugagauucagagacugugagccaguguggacuuuguugauuggaaaagguugucuuagcuuuuaacauguuguacuucaacauuuacagucuggcuuugggagaaguacagcucugggucuaauuuuuauauuucaagagguaaaaaguuuuaguuuuaaaauuuugguaccuaaaaguaauagugucuaguuugcuagccuuuuguagcuaugcaacuuuaaauaauugucuugguuucauuagccacauuucaugucuugaguagucaugacuaugacugcccuaugauggagugcucucuaaggcaaguacacuuccuauuacauugacaguugcccagaggucacaguguaccugaacugucggucagucagagagcuuucuauggaguugaacuuacucacugucauaaccaucaugagccugcacaccauuuucuuuuuaaugcuuaaugguggggagaauucuucuuauguggauugaaguucuaauaacugugucuuuuguuugccuuuucuggcuuuacuguuuuaacuuuuuccccagacagugcagugcuugcuagacagcggugcugauauuaacaggccgaauguaucaggagccacgccacuguacuuugcuugcagguaccaaacuuuguauuuucagauaugcuuccauuaaagaauguuaucuuuuaccuauauuuucacacauaaagacuguguauaguuuuuaaagcucuguuuuccuacaaauacuuugcuuuuauguagcaugauaaauaccuuucuguuacuuaauugcaggaaagcauuuucuauuaauauuauugucauuugagauaagaucuuacucuguagcccaggguugcuuagaauguacaguguagcucauuggcuggcaucaaacuuuagguccuccuccuucagccuccuaaaugcugggauuauaagauagacacuuaguacuuagcauuucauuuaauuggcaguauuuucaucaguggagcuguuuuuauuuacuugacuacuucaguuuuaggacaaagcaguaauucagagaguucuguaguuuauuaaguaccuaggaaaacuguugugugugcguuggcucagagccaagucuuuucuuuauuuauauaacuuuuuuaaaaguguugaaucauuguaaguuuguguucuguauucugccuuugcacuccugucuuaguuauuuuucuugacuuguuauuuuguuuucuaacucuuguaaguagcaaguacuuagcuuacucaccauaucacgaauacauguaagaauuaguaagcagugauaacuaggcugggguguacuagcagacaugccuaggcauaugucaaagguccuucuuccauccccagcaucagcaacacaaaacaaaccccaaacuauaauguacaaauuauauuuacacuuguaccuguaaacaugccuauaaaugugucacauagagggaguuugcaguuaggaauagugcagaaaccuacuguaacuaauuuuguuguuguuguuugcuuuccagucuuauaguugucccuugguauccuuggguauuggcucuaaaacaacuuuuucacuccugauggauauucacauuuaauauaaagucacccuauguaaaaugccaaaguauuuauaugcaauuguuaaacaucuuccuauauagcuuaaccauugcuugcaucuaauguaaaugcuauguagauaguuguuguaccauauuguuucagaaaucauaagagaaaaaguauauacauacucgauauagauacaacaauuguacacauaacuguauuuuccauccauauggaacccauagguauggauggcugcuuguaugucaguuauauucuuucauuuaaauuucuaagagauucuagaaacuuauccuguucuuuuauaucauuuaaaaauuacuuauuuugauuuucucuguguguguguuguauguaugugcaucauaugcauaccugguaccuguggagcccagaagagugugucugauuuucuggaccuggauucacagguaguuguuagcugccaucuggaugcugugaauugaaccugcauucuuuacaagagcagcaagcacucuuaggcacugagcagucucuucagaccucuuuuauaucauuuuacuagagacuuaucuucagcagaaagaugugucuuuuuccuguuuugguuguuauugauacuaccuuaucaaacugacuuagcucaucuauuaauuuuaaaaaguuucaguguuaauuauguguaggugugucuuuuggaaguauguguacauaaugauaguugccuauggaggccagaagagagugucagaugucaaaugcccuggugcugcaguuagagguaacugucacuuacuuaccauucuggaaacugaacucagguccucugcaagaguagagcauauuuuuaacuagugagcuuucucuccgaccuucuuaaacccuuuacuugaggcaauuuacaaaacucuguaguugugugggugugggugucuaucucucuauaauuuacuauuuuuaaaauuuauaaucacaucauucuauccccuccuaugcaacaccacuguccucucucaaaauucuuggccucuuuuucuuuaauugucguuuuacacacacacacgcacguaaguauguaaauauaauccauguuaauaugauauuuuuaauuuaaacuaugugaguuauaaaacuuaguuaagcuguuauaauuaaggaguuuuuacauauuacaacuuuuugaguuuuagucuucuaguucauuucugaguucaguauaaucuuauucuuaugauuuaagugauugguggauaaauguauaggaauuuuacacuccagcagcaugguugcucuggcaagggaucacacccaaauuuacaauccagcuggaauguagacaugccacacaccuuuaaucccuguggcuggaauacagacacauccuuaguauacaccauugaucccaaacaauaaugacuaauugaggggcagacaaagugaugaaucagagaaagauuugacagaaugagucagauaugauacacccaacucucaugaggacagacaggaaagagaggcuacuuaaagaguagugagggauagagagugcauccauucaauucaguucacuugugcucaguucaguucacagcaguuuaguauccggagaaaggcucugagaagucaguuugaguuagucagcuuugggaggaguuugaaccagaacaaccgaguugaaccaaccagccaguguuuagaaagagcuagaaaguguggaaagugugaguuuauucagcaguaagucuuggaagcggaaacauucuaggccucgauuagcugauggcuaaaugcugaagcuggucuggacucguagaagauuagauuauaugggggcuagggauaguuagaaucuagguauaugggcucaguccaagccauguauuugaaaagcuuggguauagcucuuaucauuuuauuugagaaaauaaaagugacauucacauuuacagauaaccaauuuccaugaccaauuaugucaugaauuuaugaaaaacauuaccuugaaucucuggaauaauauucuaccuuuuauauuaaauuuuuugaaaacauugucauuuuauguuuauggaugguuuccugucuguaugucuguauacauguaugucuguauacaugcaaaguauguauguaugucuguauacauguguaugcaauacccuuggaggccaggagaagauuucagauccccuggaacuggaguuccuggacugugguaagacuccacggugcugggaauuaaaccucguuccuuuggaagagcagucagugcuuuuaacugcugagucauuucuucagcccauuuaaaauuuuuaaaauucuuuaaauuuuucucuauauuauaaucuuugguguuuauuuuuagauuagaaauaucuuugaggcucccaguuuggcuacauuaucauaggaacucucagauuuuaacaugucccaaauacaacaucuuauuuuccucuucguaucuuucuuguaccucauaucuuccuacuuguuuaaugcagaaauuaaaucaucauuaccuuuugacucugcauuugggaccuauuauuaguaaguucuuuaaagucuuccuucagaacguuuuuugcaucuguagacucucucuaaagcuacuugaaaguuguuacaucuagaguacugcugaagucaaccuacucccccugacuguacucuugcuucugucuaguaaacucuuuccucagugaagaguuuccucaguggcccuuugaaaaacaaccaaaaaaaaaaaaaaaaaaaaaacaacaacaacaacaacaacaaaaguaaguucuugccacuugagaguguuucauuguguccuuggugcaucucacauaagccaagagucucuaggccugugagacucacucaguucucacuuguuuuagccaugcuuguccucuuuguguucucuaagugccagugcccacuguaguuucuccaugguguuuugccuguugugguuuuguaggcauuuuguguggcuuuaacuucacuugacaccugccaccugcuuuugguggagauaggagugugauccaugcugccucaaccuugugauucuccugccucugcauucccuaggcuuggauuauagaugugucccuggugucuuagucugcuuuuguugcugugacaaaagugaccaaaaucagcuugggaaagaaagguuuauuuggguuucauaugccugcucacacaguucacuaaggaaagccaaggcagcaauucaagacaggaaacuggaggcaggaacggaagcagagacgauggaggaacuuaguuuguacuuagguguuuagugagugcuuguaagugaaucaccauaguuacacaugaaacaauggcauucaaaauauuuaauacaauauauuuuaugcagaacuggacuauuccuauagcuagucugaauacaagaauauggcuaagagauuguuuuaaaaguauuuauuuuuuuccauauucauacgaaagauuuuuuuuaaaacucagguaugugccuguguauguguuacuaggaauuaaacacagggacauugugccaugcuaagcuauucuuaauuuuuauuuuagagacaguguuauucuaguccagucuggcuuguuacuacaugggcaaagcuggccuagaacucgugacuguccuuuucuccucagccaaaugcucagcauuaugggcauggccgcuggguugacaauuuuuacuuuagcaagcauugaaucuuuuugagaaaagguaguaagaagugaaacaaaaaauaaauuucucauuguaggagaaugauauauggggcacuguucauuuuacuucuaaccuguccuaauuuguguggugacaccugauuguaugugugcaaaggccagagaagaacguaaguguucaguaagccccugugauccuccugucucggcaccucuagcagugcugagguuacaggugugcaugccugguggcuuauauaggugcuuccucaugcuugcccaguacacacucagaccucccugagcgucucuguagcccucagggcauggucuuaauugcacugugauuucuacauucucagguauuuucucuauuuacagauaacuuuuauuaggaaaguaaaacaaauugaacauauauagguaaguuguuggaguuuuagagguuuuugaggcguuacaaaaguacaagcuucagagcauagaguguaacuccugccaagcaaugcuuuuuaguuagaaaacucaaacaagauaguauauaaaauagccuuuacauuuaaauacacaaaccuguaaaauaguaaucuguucauaaucaacuaaaacuguuacuacuuuaguucccauuauuagauacacuaguggaugcucuuagacauuuaagagcccaaaguuagaaagcuggguuggagaagcaguucuccuuucauaaacuacauuauggcucuggaacgauuauuaucucaaucaguauaagaauuagucuuucuaggcagagucuuuucuuuaaauguggcccugccaggaugacugcacuguacuggaugggaugccccacacccagaguauguggguggcacaaauuggacuuagugaggauauugggaaggacauggacuugggaggacagucugggaggacguaggaggaggaaugguagggugaguauggaauuaccaaagaguuaauaaacauauaauuagcuuuaauuuuuuauaaagaauaauuauucaguaaacuuugucaguuauuuaguuuaaagauuauuuuaauacuaaauaugcuaaaauacagucaaguguucaaaacaucagccugugaaggcuaacccaaaauacacugcaguguuucccauugaguauauuuguacuccauuuguaucuuagauacaaggcauuauauaucauucuguguguuucuguuuauuuuaguggauuuaauuauaaagcuggcuauuaaaaacaguuggcgcaggggaccagggcuaagaaaugggaguagguggguaggggagcagggcagggggaggguacagggaacuuucgggauagcauuugaaauguaaauaaagaaaguauguaauuaaacaaacaaacaaacaaaaaacaguuggcaauuaaaaaaaaucuuaggugugguagugcugguuuuuaguaugaguacauaggcaaaguacaucuguuuuuaguaucaguacaacugagacugguuaguauuagcuaguguuuagugcugguuuuuaguaucagugcaacugauaagagacaggcagaucucuuuauguucaaggcuauucuggucuacuaagcaaguuccaggccauccaggguuacauagugagauccuaucuaaaaaaucaaacaaaaauauuuuuucuguaacucuucauagucuuucauaggauaauuguaaacuauuacaauuuauauauguggcacuuggacuacuaauugugcuuuuuacauauugugugucacaagcaguuguuucuuauuuuuaauccauuuuugaaaugaagagucacuuuaagugugauuuucagauauuucuugaaauauaguuuucucaaaaugcaguggcauuucuucaugugcauuauucuuuuuguuuguuuuuuugagacaggguagaccaggcuagccuugaacucagaaauccaccugucucugccucacuacugcccggcgaauuuuucuuuuuaaagauuuauuuuuauuacuuccuuuacaauaagauuuuaaaaugucuauguauguguuucgucugccuguaugacuuuguaucauuugagugccuggugccgggggcauucaggagugggcauuagauccucuggagcuggaguaacagauggcugggagcugccauguggguacugggcacugaacccugaucuuuugcaaguguucuucauuacggagccaucucuccagccccaagguuuauuuuacuuuuaauuuuguguauauguaugugccuguguauaggcauauguaucaaagugcuagugcccacaggugacacuggaucccccugugcaggaguacagacauuuguacagacacuugacauggguuugcugggaacuaagcucagagacacucagccucuaagcugccucucuagcccucgugguaauauuuuguuuugcuauauguaugaccaaaauuuuuauauggaggcuuaaaaaacagcuauguaguuuuuauuuguugaucuugagcaacuauuuacucuugaaacuuuggauggaccuuuuaggaagaaacucuagauagauuaaagaacaccacauaagcuaaauagugcucagggauucagagagcgcugugcuaguagugucucaacagugagcccugaggcagugugcaugaugacugcagccauggguuugguuuauuugggcguagucugauggauuggcucugugguuggcugaaaccuaaucugugaacguagagguaaaauacucaguuuguccuacucaccauauagacuacuucugucacucugaaaugggaggcguuuccuccccgucagggagccaacacuugauuaugcaguggccauaaguugaacaucuucugagucaguuguuacuccaucuacugggugauagugucugaucccagaaguugugggcucaguccuaauagauuacucugcaucuuagguacuuggagcaggucuuauccuuugugguuucugaccuggcugccagcugggcuuucuaggacucccuccuugcguuggaauaauuuggcagaguggcucguagaucucagggagacugugcuuguguuuauuagauuuaugacagauauuuuaagagacauaaauaaacaccagucacagagacccauagaguaaggucuagaagacucuuacguguaggagcuccauuucuuguagauaguuugaugagaugcaccacccucugggauggcuucuuagucaccuuccuauaaggcugucucuucucagccagccaggaguuuuccaguucugauugguuuuuuuuguuuguuuguuuuuguuuuuguucuuguuuuuuaauggaagcuucguuguauuggcuugauugaaacauguacaacugugccaaaggaggugugugacuuacuauguuaggacagaguggcaaacccagccggaguuucuguucaaggucuucauggucuuugggcagcacuccuuccuuucaggugcgagguagggcacugucugaacugcgggcccugagauugauccuuagacaggguagaugggaaagaugucagaggagauacuuuuacucucuauggcccacuuaggauaauuugccuuggugaaacaaggagcugcuugaugagggcaggauaguacugcagaggauuugguccuaacagccuaacaaaaacugucuuuuuacuugaguguuccaaagcuacuucaagaaccaaggccagaaggccaaauacacuacuccuauuucucuaguuacuuaagauauaacaagaaauuaagcaagagcuagaaagugugggugaacacacacacacacacacacacacacacacacacacacacacccucacacacccucugucacaucugaauauuuguuaugaacgacaugcucuuccuugcuuauuuacuguugcauaggagccaucuccuguugcacagggacaucuuuuaggcuaaugguuuccuguuuauuuaacaacucauguaacacagcugucacaguuacauuccugaugacgaaaagacuaagauaacauuugucaccuauuagauucuacgaaauuguguuaggcuucugcuaguuauuuccuuucuuucuucauccauucuguaaugcuuauuuaucaaguguaugaaauauguuaaagcuuagaguauaauuuauaaagugugaugagucuguguuauaugccacuaccauucuaggugcuguagaauaagucugcuauguagauauuggcagcuuaggggcuggagagaugacauagcagccuguaacagcacuugucauggcagaggaccaguguucaguucccagcauuuagauggggacugacaaccauucuuaacucauuucuaaaggaccugacuccuucuuuugcccuccgaggacaccaggcaaauacauggugcacacauacacauguagggaaaauauacauuauaaaauaaauaaauguaaaaaguuugaaaguugacaauuucagcagaaagacugaaaauauggacauuaagcaacuguaaguuauuaaaauuggauaguuuuuauaaaaacucuagauuauugacaucuagcagaggugccacuguguucugauauaaguuaaguuuaucuuggugacuuuucaauuuuaguuucggggcauaauaggaagcagccuaacauaggguaguauaaguuaaauaguauuguaauagcuguaucauacuuuggcugguaacaccagcauaauaacacugaugccuggugaagacuucugagcauucugcucuacaucuguaucagcagcuaugugacugaggcagaauugcccugaguuuggggccagccuggacuacagagugagauuucuuauugaauauuaauaauaaugcuaauuacuguuguuuucagaggaucgaucuacugguuuguuugguuuugcuggcaaaauuuggcuacuauuaaaauuauuuauuuauuuaguguguguguuuugccugaguguauaugucuguauaccacuugugugcuuguugccugacgaggacagaagaggguauugaaucuuuugaaacuugaaacuggaguuacauucaguugugagccuccaaguagguacugggaauugaacucugauccccuggaagaguagagguucucuuaacugcugagccaucucuccaccccccuagauuauuauucuuaaguuaguucugguuaauugguauguguaucaaggacaguaauuacuguugucauaaauuaucaacagaaugauaaaaccuauuauaguuguucacuaaauucauagcagggcacuaugaauguuuaauucaaauuggcuauaaauuauguuuuguacagugccauuugguugaaauacagugagcuuguuuuuaauuuguuuacauuucugggaaaucugcauagucucuauugcugucaagugaugugucucuguauuguaguguucuaauuuauagagaaaaguuaaauucaaagauuagguuuuuaacuugguucuauuucuauacagucauggucagagagauacugcacagauucuucuauuacgaggagccaaauauuuaccagauaaaaauggaguaaccccucuagaucuauguguacagguaugcuuuuaauauauaauuccaagcgcauuuaugauagaaauuauaaauuauaaaauaaugguuuuuuguaaaugagaguaugaagauguuuagucugugaaaaguaugaucuuuaaaugucucuuuguuuuuaaaccugaaaaauuguaaauuuuguuuuuagggugguuacggacagacuugugaaguguuaauucaguaccacccgaggcuuuuccagacuauuguucaaaugacacagaaugaagaccuucgggaaaacaugguagcauaagcuugcuaauagguuguaaaugaguaguaauuaaaauuguuauguuuauuuuaguaaugaguugguugugcauuauaugaguuauaguuagcccuugauauauggggauucuacagccaaaaaaccaauuauugaucaaaaauauuauaaucaaacaugaucagacuuuuugucauuauucccuaaaaaaauacaguauagcaacuauuuacauagcacuuauauuuuauuaaacaugacaaauuaugugaagaugacuuuaaguuuaugagaaaauaugcauugaauauauucaguugcuauauuuuauaaaaaaugugaacaucuagagguuuuggguguuuagggacaaguuggaguuaacaggaauauuguagugugguauaaauaauaacaugucuuauugacauuagcccucugaaucaccugaguggcuuuccuuaugauaauuaccucauggauagaggacaggaauaugaaggaggaauacuuuguaaugacuggaaacuacuugaucacugagcucuuuuuccuguaguuuugugcugcuaggguguaaaccuggggccaugccugcugagcuauaucuucaaccccaagcucaguauuuguaauagcuauaaucuuggaaaaguugcagauuuggaaaucuuuauaaacuucagauguuuagaauuaaauuuuuagaugcauacuugauuuccuguguauuuuuuaacuggauaauuuugaagaaagauuguuuuucaucuuuuucuuuuauuggcucuuaaguuuauauagaguauaauaauuguaagguucuugauuuuaguugacugccuuuaaggcauuuauuaagcauguguauauauugauagaauaaauggguuacucacucuguaaucacuuugguuuuuaauuuauauaaaaccaguuacggcaaguucugcagcauuugucucagcaaagugaaagccaguaccuaaagauccugacaggccuugcugaaguugcuacgacaaauggccauaagcugcuuagguaagcauuccagggacucaguacagaggagugucugucugcuugaucuccucaguaauuagcuaucuuuugucauugaugagcuguguaaacaauuugcugacuuacccuauuaguuacuuuucuacacugugauagcacuaugucuuuggcaacuuagagaaggguccaucuacuuaagguugucggggauaagagugcauugcggcagggaagcauggcagcaagcagcaggcaaggcagcaggagcagaagcugaggauucacaccuucacucaaaacaggaagcagagagcaggcucuaaguggugcacauuuuaaacucuuaaagccccuguccaguucaauaacucacgucgguaacaauaaggcuacaccuccugaguuucuccaaagggccuccaacuucagagcaagcaugcauaugccuaggcuguagggccuucucauugaaaccaccacauuuaagguuugucauucuguuuaaaaagcccuggcugaucagcuuaucuaagagacuuuauaaagaaaccuagaacauacuaaugugaauuuuggcauauguguacggaauuuuguaaaaugauugcuuaagauuaguccuaccaguaaacgcgugugaagaagcugcuauugucuuggguguggucauauuuccuuucagucuaggcaguugagaucaaaaguaggaggaccaggaguucaaggucauccucagcuacauaaggaguuuguggucagccagggcuacaggagaacauaguccaggacucugaaucgccgaguuacaaaauugggucgauccccuacuguuucaguguucagcauuccuucaucauauucauuauaguuuuuuuuccuguacuguuucucucccuacuucaguuuuuaauucuuuuuuuuuguuuuguuuugguuuuuuuuguuuuuguuuuuguuuuuucgagacaggguuucucuguauaucccuggcuguccuggaacucacuuuguagaccaggcuggccucgaauucagaaauccgccugacucugccucccaagugcugggauuaaaggugugugccaccaccgcccggcuuuaauucuuuuuagauucuaugguuuuaauaacucauugcugagccuaaggaacuaaacuuuauauugcuuacuuuuauauauagcuuauaucuuugcuguacaucuuuguaugugauuagccacuccuacuaggagaauaggcagcuauuaccaaguacuuaauguguuacuguuucuuaugcauuugacccucuucuaauuuaaugcauucuucuuuguaugacucacuaauuauuucuacagugacaguuugugauaaccuuuuaccuuuguacauugcuacagaacuuucucuuucuacaugcagagucuaugaaaacuaugcauacaaagcuacauugucagacuuaugguuauucccaugaaagucauucugcaucaacaguugccuucucuuucccgacagggucuugcuguauagcucuggcuggcucugaacuuguuuagggucuugcuauguagcucaggcuggcuuugaacuugaugucuucauguuucaugcucugaagugggaauacauuugugagcuacuuauucucugcuacuuucugugcuccuguacucuuuacuugaaaggucuucugcuaauucagaccaguaucaccuucuuacuuguuuguauuuccuaaguugcuuuugauauucucuuuggaagcacuuuuagauucuucugcuuuaugacucauuggagccaagguuuccauaauguacucuguccauuuuuguuuagucauuccuaguaacucauguauuucaugaaaccugagacuuagauaggcuaauuaaaucauaggagggaagaaguggagggguaugaaugaggacuauauuugaucaaaacacauuauaugcauauaugaaauucugaauuaaaagcauaugcauauuucuauccgucucuuuuauaauacagugagguauaauuugugacuuuaaaauaauaugcuaaaacucaaaaaccaaccaaccaacaacaaaaaaaccccccaugggcuauggacuuuggagccuuccagauacaguuguaaguucagacacuguuuacuaacuuguuacacaccagcuuugacauccaggguaaacugaggugggguguaaagucaguaauucacaaguacacuuuuggaagugaauaaauuuccuuaacguuuguaucuaaagauaguauucuucauaguuuaugcuauacuggugguauauucauugguuauauucuggguacuuaaaaauuagaaaucuaauucauaacaaauaauaaauuuaauaccauguauuaauauauacuuaauguuacauacuaauauauauauauauauauauauauauauauauauauauaaauaaaauauauuuucugcucaacaaacuucuuucuccuagaauggguaagaaauuaucuuaacacagagaauucaugagacaguugguuagugaacuaaauauguuuaaaauaaauauuugaaaaucaauuuguuugguuccaccuaauguguucauauuuuaauuuuucauuuucaguuuaucuagcaauuaugaugcgcagaugaagagccuuuugaggauugugaggauauuuugucaugucuuucgaauuggucccucaucucccaguaauggaaucgauaugggcuacaauggaaauaaaacuccaagaagccagguguucaaggucagaaacguuguuguuaggagguagacauaaaggagaugacuaaaacacagcauacauucauuaaaaucaugagcaagauauaaguuugguucauaacuugguuacauauuuccccuuucaguuuugucuaaugaacaagauuuaauugguaagcuuuucaaguuuuucuuacacauaaaucaaucccauucgugcuuuuaaggauagagauauuuaguauuaaaguaauuauauugaauuacaaguuuauuuauuuuaugcaauauuaaauguugaagcuagggcuaucugugugcaauggaaaguuaacccuagcuuacuuuuuacuuugagacagaaucucauuaaguuggucagacugaccuguuccuuguuugguagcugaggcaggccucccuccuaaguagcugggauuacagauuuuagccaccagguccaacucagauaaugaauuuuuaaugcaaaauguaagccaucaucuuaaaaauguuuaacuagaagauaaaauaaccugguuuuguuauuuguauuauauacgugcuguuugugucuguauuauauauuuuggaagaaaggcuacucuuacuuaauaguucuauuaacaauuccugggauuaucuuaacaaagaguauuuuuaaaaaauacuuuucauuacuuuggcugccuuuccuaacacauaucauuguuauuacccauaucaaauuauguguuuaugaacuagcuaugcauacucuguugauaauaauguuuuuuuguuauaguuuuauguaagacuaugguuuugaucuucagcacagcaggaauuaagcaguaacaacaaagaagcaugucugugcacagcaaauguacuugugggucacacuuugagcaguuuauucuguauuaucuuuaaggguaguagguuucugugcuauaaaauuuacuuuugagguucacaaagacguuauuucuugcaacaguguuuagguuaucucuccaacuaagacaaauauuuuuuuuuauguaauauaacuuauugaaaagauuuaguuaguguuuauaaaacuugaaucuaaguuaauguuauaugcuaaauaauucugguuauuauagcuaaauaacuuuaucuuacaugaaccuuuugacauacuuaacagauaaauggcuugcaagcauuuugauauuauauuaaaaguuauuuguguauuaucauugugagugauguguguauuugaguucaggcuuguggugucaguugucuccucucugccuuucugcaggucuggguauugaguucauguagcaagcacuuuaccugcuaagccacugugcugaccacacuguacucuugaaucuaagaauaggugugauagccccuuaggaaggugccuguuaucuguguuucauucuuuuuuccuuuuggaaucaguacaggaaagauaauuuucaccuauacauauuuguuuccuuuuacuucuuuuuucaccucuugugccaccuucuggaagaaggaaaccaagcaguuuuugguuuccacauccuguuuucuuuaguuaggauuugcaguuuacuacucuuguagcauuucuauccaaguggccaaucugcuccuuugucagggcuuuucucagugagguuuacuccucgcgugacaucauaugaugcuauucuuaauguagucuggcaugguuuacuauguuagcacuuacucccguauuuuacuuucuacucagcuauaaugauaaguaggaaauuaugguagguauagguagcagucacuauuuccuuauucuuaaaauuugaaucugucuugcuaauaggcuuagcauaaacauauuaacaguuggcuuaaugcuaguuuucuauuuaaucaaugcaggguuaacuguaacaaaguaugucaaagauacuguuuccuauacucuccugcugcguuuuuuucaguguugggacguaaauauaaguccucacauaugcuaggugacauaguuuuucuuuguuuaaugaaauucagacuuuuuuuuugucauguaguuauggguuuucuuuccuuuuacuuuuuguguacugggaaaugaacccagaaccucauauuuuuuaggcaggugcucagcugccaaacaaggaacaggucagucugaccaacuuaaugagauccugucucaaaguaaaaaguaagcuauauucugaccauucaauaguuuuuaauuaaugaguauucauaccauguuuugaucaacuccuccaagauccccuaccacccugcccaccaaacuuuaucuacauuauaucuugucuuucugcucccuuacucccuuccucuuucuuucuuaaucaaaugaaaaucaucacaucaauaagaaaaaaacauaauaaaacaaaacagaaagucaccccccacccaccccaacccagaaacaaaacaaugauccuuuuguguggccagggcacagggccugucuaggagugugauugauacacccaaugucauuccauuguagaaaacugauuuuccacuucacagcaaguaucaauuguaaacacuucuuguuuaaugaugggacugcaucucuaguuccccaucucagugauaggacccuggcuggcguaucccuauguagggcuugugugugcuuccacagucuguaaguucaugugaguaucaauccuguugugucuggaaaacacuguuuccuuaggucaucuaacaccauuggcucugaacguauuucuuccuccucuuuuggauaguucccugaaccuugacagagggguuugaugaagacaucugucuuaggguuuccauugcugugaacagacaccaagaccaaggcaacucuuaucagggauaacauuuaauuagggcugccuuacagguuaagaggugcaguccauuaucagcaaggugggaagcaugacagcaugcaggcagacacugugcuagagaaggagcugagaguucuacaucuugaucugaaggcaggcaggcaggaggagacuggcaucuacaaguagcaaggagcauugagcauaggaccuuaaaguccacccccacagugacauacuucuaccaacaaggccauaccuccuaauagugcuauuucucaugggguaaucauauuccaaccaccacaauauccaauuaagacugaguacuccaaagucuccugcucugugcauuguccaauugugaggucuugugcugauucccaucuguugcaagaaguuucucugauguggacacuuugccccuucuuagaauugggaacaaaacacccauggaaggaguuacagagacacaguaguuuggagcugugacgaaagguggaccaucuagagacugccauaccuggagauccaucccaugaucagccuccaaaugccaacaccauugcauacacuagcaagauuuugcugaaaggacccugauauagguguuucuugugagacugugccggggccuagcaaacacagaaguggaugcucacaguuagcuauuggauggaucacagggcccccaauggaggagcuagagaaaguacccaaggagcuaaagggaucugcaacccuauagguggaacaacaauaugaacuaaccaguaccccuuggagcucgugucucuagcugcauauguagcagaagauggccuaguuggccaucaguggaaagagaggcccauugguugugcaaacuuuaucugucucaguacaggggaacgccagggccaagaagugggagugggugggugggugagugggugggugagcgggugcaggacuuuugggauagcauuggaaauguaaaugaaguaaauaccuaauaagaaaacaaacaaacaaaaauuuucucugacgaggaaugagcacagcacuugaaccuaugguuauuaccuuuuuuuuuuuguuuuugguuuuuuuucaagacaggguuucucuguguagcccuggcuauccuggaacucacuucguagaccaggcuggccucgaacucagaaauccaccugccucugccucccgagugcugggauuaaagaugugcgccaccacaccuggcugauuuuuuuuuuuuaagauuuauuuauuuauuauauguaaguacacuguagcugucuucagacacaccagaagagagagucagaucucguuacggaugguugugagccaccaugugguugcugggauuugaacucaggaccuuuggaagagcagucgggugcucuuacccacugagccaucuuaccagccccugguuauuaccuuuuaauuaauuaauuuguaguuuaauuuauccuuuuauugaaaauagauuuuuuucuuuauacauauagauugugguuucagcuucuccuagcucuuucaaccccccccccuucuauugauaucuaccccacuuuugucucuuacuagaaagcagacagguuucugugggacaauaaggaaauaaaauaggauaaaacaaaaacuaacccuggagugggacaagacaaacaaggaaacgagcccaaggaagguacaagagacagagcccccuuguuugcauucaggaacccccauguaacacuaaacugaaagcccuaguguauccacagugggccuggugcagaugcaugcagacccucaugcagccucagucucugaguucacaucaccuuuguucaccucgauuuggagggucuuguguucuucccguguuccaccccuccagcuuugcucucuuucugccucuucuccugcucucgaggggaaggauuugauggaugcauuguuuuuaggggcugagugauccaagaucucucauucuuuguacaguaucugccugugggcuuucauggguuuuuuuccaaaugcuguaguaggaaacuucucugaugaugguugagcaagccauugaucuaugaguauagguaaaucucuuuaggagucauuuauugcuauauuuuccuuuuuucuuauuuguguguguguguguguguguguguuuuaaggccaguauuauuugguuuuacccuagaucccugagcuaucuagucucagguucuuggucacucaaguaguguuggcuauggguuccagauuuugcagugggccuuaagucaaaucauuuauuuccuaguugauuauguccacaagcuuugugucaccauugccguagcauaucuugcaggcaggucaccauaauagaucagaggguuugcguuucaguugaugauaguauuucuccccuuggguugcaugaagaguaccuuucuucauauaccacuuagguguggcaggugccuauucuguguagacaccagcucaacaucuucauguucagugagcuauguaaguguugucuucgucaaugaggccuugcugucaauaugaagaaagugaccuauaguuuuggcaucagccugguuuguuugagugguggggguggggucuuaugggacuucuuuggcuaccaacucaauuagaugugucucauucucaauauuggaauuuucauuuggugacaagagauggcuaguuggggcuuugacucucccauuguuugacaguuuuauuuagaucuccaucauauaugcauauauuuuaggaagauuuuacugugcuagguuucuguaauacuccucaaaugucacuuaauuuuagcuguccccauauucccucccucaucuccuggucccuccccuucuuuacuccguccuccuauaccauucucccucucccuccauccuuccauaacuaucuauucuacuucccuuuccuaggagauauaucuguucccgcucuggaguccuuuacuguaugccugcccucuguggcucuauggauuguagcuugguuauuauuaaauuaauagccagcauccacacuuggucuggguuacuucacuuaggguaauaggucuuaguuucaucuguuuaccugugaauuuuauggcuuuuaaaaaaugacugaauguaaauuguaccauuguguaauaccauauuuucuuuauccauucaucugauguuuacacuuucuggcuguauggcuagaacagcacugaaaugauugaaaaagcaucucugugcuaggaugaaacauucuuugggugaaugcccaagaaugcuauagcugcgucuugagguagaucgauuuucauugauuucuguaguggcuguacaaguuugcacucccaucagcaauggaugaguguuccccuuguuccacauucucaccagcaagagcugucaauugguuuauugaucuaagccauucugacugcuguaaugugaaauaucgaaaguaguuuugauuugcauuuuccauaugacuaaggaugcuaaacauuuuuuuuaagcguuuucagccauuugaguuuacucugagaauucuguuuagaucuguacccuauuuuuaaaauugaguuauuuguuuuauugauaucuaauuuuuuggguucucuauuuauuuuggauauuagcucucuguugcauguguaguugguaaaaaaccuuuccccauucuguaagcugcugcuuuguucauauggccaugucuuuuucugugcagaaggcuuucaauuuugugagguuccauuuauuguugaucuuacugccugugcuaacacuguuggcagauagucuucaugugccaaugaguccaaggcuauucccaccauguugaaguuugugaugcauuuggaguugaguuuugugcagggugauagguauggguuuauuugcauucuucuaaauguagccagccaguuugacgggcaccauuuguugaagauacuaucucuuuuccaauguguauuucuggcgaguguguguguguguguguguuguuuuuuucuuucuuuuuuccacucaaagaaucagguguucuuaccuguguggauuuuuugccuggguugucaguucaguucccuugaugaaaggguaucugucuuugugucaguaccaugcuguuuuuaguacuauagcucuguaguaaaacuuauaaauuagggauggugauaguucuuuuaucauucaagauuguuuaagcuauccugggagauucacuuuguuuuguuuuucuauguuaagcugaaaauuguccuuucaagcuccuugaagaaguguuggaguuuugguggugaucauauugagucuggaaauuugcuuuuaauaggauggccauuuuuacuauguuaauccuacugauccaugagcauggaugaucuucccaucuucugauaucuucauuuucuuacuuccaugauuugauguuuuuaauuagacuggucuuugacuugugauaucccaugacuuuuucuauuuuuugaagcuuuugugaaaaguguugauucccugauuucuuucucaaacucuuugccauuuguauauaggaaggcuacugauuuuugugaguuaauuuuguauucagcuauuuugcuaaaaguguuuguuuaaaugguggauuaccuuuauugauuuacauauguugaacuauccuugagugucugggaagacgacuugaucguggugggugauguuuuuguguacucuuggauuugauuugcagguauuuuacaaguugacuaaaaaauaaaaugcuacagaaauuaaguauuaacuguuaaaguuucuguuagcuuuuuaaauuaaauaugguguauuugagugauggggaaaccaucuaacuucuugaauguaaagauaaauuagagacuguugcuaugcauucauguuaaguucaugguggggugaucaaguugugaacuccuggacuauuugcugugauguuggacuggaaauacauguucccuuuaccacauucuaagguagcaguugaucccuacuugucaucucauuaagucugcaugucacuuuauuguaaggaauaccucaugggccuuccauuagagcugaggguguuuauaggccauuugguuuuagugggugaaauagucuaacauccuguuauuagggguuucugauuuauuugagaaguccuuuaagcuaaucauaacacucaccacucuuucaguuuuaagagauuuucucuagugucuagcagcuuggcaguauuugaaagagaauauuguuuuuguuuuguuauuggacagugagcauaauggguggugauauacccuuuucuucccaauaguaagcugugacuuuuagugguuucauagaaauguaauuuagaauaaguuuuuuaguagccaagaaaaaguugagaaaguuagcuuaacaauuuuuuuugucaugggauauuauuuaguugagaagaacaggauuugaaagugcuaugaaauacaugaacuuaaguuagcuuuccugucacauuuugauuucacuucagaauaucuugagauuuuaaaauaguuucccaguaagcuugggguuauauaugugucauacaaauacagcacgcacacucacacacacacacacacacacacacaccuuagaguauaaauuaagguuguuugugaaucauaugacauuauguuauauuacucuugcuguguguagaaauauaauuuugugcucaugaucacuuaguuuaugaaacgaaacaauuauguugguacugucaagaaaccuguuuaauauauuucuucuuguuauugauuuauuuuuauuuuauguguauggauaacuggucugcaucuaugucuguguaucucacacaugccugguacccaaggaauccagaaaaaggucuuggauucccuggcacuggagguggagauauuugugagucaucacgcaggugcuaggaaucgaaccugagccuugaaguacucuuaguauuaccaagccacacacccacagcgcaucuuccucagugccaguugauauauauguuuuguaucuaauauauuuuguuauccauaaauauugcaaguaccauaauuaugacaugcaauaguuuauuuaauguuucuaugcucauaaucaagccuggagcucuggcaccuacuagacagauggugauaacagagccuuaccuccagccccaguauuuuccuucugauucucaucuuacucuuuuugugccuguggcuaguuauuauagguacgagugcucccuucugugacuaacaaaugacgucucagggagguaauucccuugguaaagucuuauccaguuuggaauuugacuuuauugaauauaugucuaagaaaauaagauaauacaaacgaggaaaaacaaaacuaaacaacaaaaaagaaagaaaaacuccaaaugauuaucuuuuucuccaguuucucuuaauucuuuccuauaauacuucauuucaaucuguaguuuuucaguauuuuugucaugauuauuugucuuccauuucaugcauggagaugcaaccccuguucuguuuggaaguuuacuucugaaguaguuugcuggcguacagagaguaaaaaacgaaccguacaggugauuuaaugcuguggucaugaaggagaacccucggacugggacuugaauccgagggcguuuucagugaugaucucauggucauccacgggcucuugccuaagcagcagcuguucuaaccacgagggcugacuauugaaaaacccucuucuagguugagaggcguguucauuucagcuucaucaaagguaaacuuaauuucauuaaaaagaggauacucuuguuuccugaauaccuugagucauuuauugagucagggaaggaggcuuuuguucaguguaguugugauuaauuuuucuuucuugcucaauauauaaaggggaaaaauagggaugaauugguuggaaagucagugaguaaaauucucagaauuacagaaagcugaaauaaagggaaagaagggaugugguggagguguuguuauuaaauaauagauaggugaagauuuuccuggcagagcagguuauuugcacaguuucuaagguugcaaauauggcuguuuaguaucuuuccaugagugaagacuacacaguuguuauuuuuaaauuauuuuaggucuuccuuaagugcuugguccaauuuacaguaucuguaauuauucaguauucaaaaguaagauuauauauucacugaaaggaggacagcuaauucuuaauaggaauauuuuaaguaguauauaaugugaagugacauuuaaccuguacucccuuucaaauucacuaaaugggcaugauuauuuuugugcucuuuguuuuucuuuaauaucucauuucuuauuagauauuuuauuuaucuacauuucagauguuaucuccuuucccaguuuccccucuggaaaugcccuauccccuucucccuuucccugcuucugugagagugcugucucaccuacucccacccccacccccaccuccaccccccacccccugcccucucauuccccuacacuggggcauugagccuuccaaggaccaagggccucuccucccauugauguuggagaaggccauccucuccuacauguguggcuggagccaugggaacucuuugauuggugguuuagucccugggaucucuuccagggggagggcucugguuguuugauauugcugaucuuccuauggguugcaaaccccuucagcuccuucaguccuuucucuaacucuucuauuggggaaccgugcucagucaaaugguuggcugggagcaucugucucuguauuugucaggcgcugucagagccucucaggagacagcuauaucaugcuccugucagcaagcacuucuuggcauccacaauagugucuggguuuggugucuguauuugggauagauuccccaaaugagggagucucuaucaaaugagggagucucuagauggccuuuccuucuggcucugcucuacuuugucuccguauuuccuccaccccugcuucuaagaaggauugaaccaucuacacuuuggucuugcuucuucuugagcuucauguggucugugaauuguauuuuggguauuucgagcuuuugggcuaauauccacuuaauagugagugcauaccacguguguucuuuugugacuggguugcuucauucaggauauuuucuaguuuuauccauuugccuaagaauuucaugaagucauugucuuuaauagcugaguaguauucuauugucucuauuguguaaauguaccacauuuucuguauccauuccucuguuuaaggacaucuggguucuuuccaacuucuagcuauuauaaauaaggcugcugugaauauaguggagcauguguucauauuacauguuggagaaucuuuugaguauaugcccaggagugguauugcuggguccucagguaauacgauguccaauuuucugauuuccacagugguugaaccagcuugcaauccuuaccaacaaugguggaguguuccucuuucuccauaucauuugcagcaucuguugucaccugaguuuuugaucuuagccauucugacuggugugagguggaaccucaggguuguuuugauuugcauuuccugaugacuaaggauggugaccauuucuuuaggugcuucucagccauucaguauucaucaguugaagaagcuuugcaauuuugugagguucauuugucuauuuuugaucuuaauagcauaagccauugguguucugcucaggaacuuuucccucugccuauguguuggaggcucuuuccccacuuucucuucuauuaguuuaaguguaucugguuuuacguggagguccuugauccaccugaacuugagcuuuguacaaggagguaagaauggaucgauuuguauucuucuacaugcugaccuccuguugaaccagcaccauuuacugucuuuuuuccacuggaugguuuuagcuccuuuguaaaagaucaagugaucauagguguguggguucauuucugggucuucaauucuauuccauugaucuaccugucugucacuguaccaauacugugcaguuuuuaucacuauugcucuguaguacagcuugagcucagggauggugacuccccuagaaguacuuuuauuguugagaauacuuuuccacuauccugaguuuuuguuauuccaaaugaauuuguaaauuucuccuuccaacucaaugaggaauugauuuggaguuuugauggagauugcauugaaucuguagauugcuuuugauaagauggcccuuuuuacuauauuacuucugccaauccaugagcaugggagaucuuuccaucuucugagaucuucuuugauuucuuucuucagagucuugaaguucuugucauacagaucuuucacuugcuggguuagagcuacaccaagguauuuuauauuauuugugaccauugugaaggauguuguuucuaauuucuuucucaacccauuuauccuuugaguagaggaaggcuacugauuuuuuuuugaguuaauuuuauauccagccacuaugcugaaguuguuuaucagguuuaggauuucucuggugaaauguuuggggucacuuaaguacacuauuuuaucaucugcaaccuugucuagacccugaguuuagugggauugcuauagcuguccagaagccauggagaaacuggguuaucagaaaggggggcuggaagugaaaaaggacugggugcuagagaaggguaaaaccaagacaaagguucugaucaaggcucgaaguuuaauacucagcacuguguuuauauagggagagcccacagaccuauccuuuguuucagcuggacuauguuguaaagcuaggucuauuuuucaaagcucauguaggaaacugcaaaugcaggaaggucugaugacuccaccuaggaguaaaacccauuguggcaaucccucaagguuuguuuauccugcucaaaugggggaggggguguguaaacauuuuuuuaaguuuuucuccauuuaguuugauguuggcuacugguuagcuguauuuugcuuuuacuauguuuaggugugggccuuaauuuccugaucuuuccaagacuuuuaucauguaguugaauuuugucacaugcuuucucagcaucuaaugaaaugaucauauggcuuuuuuccuuugacuuuguuuacauacuggauuacauugauggauuuucguauauugaaccaucccugccugcaucccuggggaaugguuuuuguguggcuuagguauaaguauaauuguggcuucauagaacgaauuaaauaguguuccuucuguuucuauuuuguggaauaguuuaaagaauauugguauuaggccuucuuugaagauuugacagaauucugcuguaaacccaucugguccugggcuuucuuuuuugguuuggagaccuuuaaugacugauucuauuuuuuuaagggguuauuagacuguuuagaugguuuaucugauccugauuuaacuuugguaccuguuguauaucuagaaaauuguucauuucauccacauuuuccaguuuuagugaguaugggcuuuuguaguaggaucugaugauuuuuuugauuuccuccauuucuguuguugugucucccuuuucauuucugauuuucucaauuugaauacugugccuucugguuagucugacuaaggguuuaucuaucuugucucaaagaaccagcuccugguuugguugauucuuuguauaguucuuucuguuucuacuugguugauuucagcccugaguuugauuauuuccugcaguccuuuuggguguguuugcuucuuuuuguuauagagcuuuuagucgugcugucaagcugcuaguuuauguucucuccaguuucuuuuuuguggcacguagagcuaugaguuuuccucuuagcacugcuuucacuuugucccuugaguuuggguauguuaugccuucaucugcauuaaauucucaaaagccucuaauuucucuauuuuuuccuugaccaaguuaucauugaguagggcuuguucagcuuccauguguuugugggcuuucuguuguuuuuguuguuauugaagaccagacuuaguccauggcgaucugaucagauacaugggauuauuucaaucuucuuguaucuguugaggccuguuuugugaucaauuauauggucagauguggagaagguaccaugaggugcugagaagaaguuauauucuucuguuuuaggugauauguucuauagagaucuguuauauccacuuggcccauaacuugugucucaguuuaguuucuguuuccaugaaauguccauugcugagagugggcuguugaagucccccacuauuauugugugaggugcagugugugcuuuuaacuuuaguuacauuucuuuuaugaauguggaugcccuugcauuuggaacauagauguucagaauuuagaguucaucuugguagauuuuuucuuugaugaguauaaaguguccuuccuuaucuuuuuugauaacuuuugguugaaaguagauuuuauuugauauuagaauggcuacuacagccuuuuucuuggagcauuugcuuggaaauuuuuuuucuagcauuuuccucugaguuagugccugucuuugucacugagguguguuuccuguaugcagcaaaaugcugggucuuguuuauauauccauucuguuagucuaugucuuuuuauuggggaaucaaauccauugauguuaagagauacuaaggaaaagugauuguugcuuccagguauuuuuguugcuagagguggcauuauguuuguguagguaucuucuuuuggguuuauugaauacuuucuugcuuuuucuaguguuuaguuuuucucccuguguuggcguuuuccaucuauuauccuuuguagggcuggauuugugaagagauguuauguuuucauggauaucuugguuucuccauuuauauuaauuuaggguuuugcuggguauaguagcuugggcuggcauuuguguucucuuacugucugucugacaucaggcuaggaucuucucacuuuuagagucuccguugagaagucugguauaauucugguaggucugccuuuauauguuacuugacccuuuccccuuacugcuuuuaguuuucuuucuuuguuuuuugcauuuggcauuuugaauacuaugugacgggaugaauuucuuuucuggucaagucuauuugguguucguuaggcuucuuguauguucauuggcaucucuuuagguuagggacguuuucuauaauuuuuguugaagauauuuacugaccauuuaaguugggaaucuucauucucuccuauaccaguauccuuauguuuggucuucucauuguauucugaauuucuuggauguuuuggguuagaagcuuuuugcauuuugcauuuucuuugacuguugugucaauguuuucuuugguaucuuuuccacuaagauucuucucucuucuaucuuuugcauucuuuuggugaugcuugcaucuaugacuccugauuucuuuccuagguuuucuaucuugaguuuucuccauuuguaauuuuuuuuaauugguucuauuuccauuuuuauauccugggugguuuucuuaaauuccuucauguguuuaguuguguuuuccugugauuuuuaaagcaauuuuuguguuuccuuuuuaagagcuuuuacuuguuuaccuguguuccccuguauuucuuuaagggaguuauuuauguucuucuuaaaguccucuaucaucaucaggagaugugauuuuuaaaucacaaucuugcuguucccacaugcugugauaucauccaggacuugcuauggugggaaaucuguguuaugaugaugccaaguagccuugguuucuguugcuuagguucuuuggcuugccucucaccaugugguguuauuugguauugcugucucugauuuuagcuuguucuuccugugugccugugagccugugagccugugagccugugaucuuagguaugucaucacuccugaggagaccagcucuccccugggugggauuugggucuggagggcuacccugagcgucagugcguagauggagauugcaaagaucuuuaucgaggcugcuccacuguuccugugccugguguuuuccuggcaugucccucuuuggacaguuauuggagugaaugugaugaucucaccuaugaucuuaggagugagagcgcuccucagagaccaacucucuccgggugggguucgugugcagaggguugugggacauacuuagcuccggguacagauggagacccuuuuguacucuuuguaaaguaauuacuauaggucauuuacauuuuaucucugauacuuggucugugaugaugugguuuaaacaauaaaaucuaauggauaauuacuucagagaagacaucucccucuucucagaggggauauucaauauucagaaguaagguucauuuuuguccagcucucuauuuaccuguuaacuuagcccuugaguaguggaugcgggagaaucuggagcucaaaguugucuuggcuauguguguaguuugacgcuaucuuaggcuagcucaccagcaguaagaaugauuugcuaagaucuaaguauagguacagaguaguacagugcaugcuugagguccuggcuuuauucuggcacugggggcaggggguagggagggacccacaguauccuugucugguuuuuuguuuuuuaaguuggacacuuauuuuaaaauuuuauugcuucguuuuucuuauuguguguuuaucugcacgugugugcaugugucuaugccugaugccaagguauguguguagaaaucagaagacaacguucuaaguccauuuucucccucuuaugugcccuaugcggaaagaauguauguugucaggcucggaagcaaaugccuuaauucacugagccaucucacuguccugccaggucuuuaguuagauaauuuagucauuuuauuccuuguuuuaaaaauuacugguuuuuggugcuagagagaugauucaucaguuaaaagcacuugaucuucuagaagauucagguucaauuccuagcacccacauggcagcuucacagucaucuguaacuccaugcccaggggaccugaugaccucugcuggcuucauugggcacuggacacacaugauacacagcuaugaaugcagauaaaacacccacacaguaaaauaacaauaauaagauaauucuaaaaauuauuagagaugaauuuuguauacaaguauauuuuaauauauacacaucuauauuauaccccacuuuuuacucucauauuauaaguuauauaaaaaaaaaagcaggaaugcuuuuuaagaagcacugugcacuaaacaguuuucucagauuuuuagcaauuuucaggcuuuuaaauaaaaaauacuugugacugaaaacuauugacaucaugauaauaaauguuagggcauuauaaaaggcaauaagugcuuuaaaagaacuuguuugaaaaaugaacaaucgcuuaaaauuuuuuguuagauuuuauuuucuuuauaaauuauaggaauaauauacauacuuuuuauaauacauuuauauuuuuuaaauauuuguauauuuucauuaucuuuaagcuugggaagauaaaaauguuuagaaucauuuucuuaugcuauacaucuguaagugagguuuuaguuuugccuuuuuuucuuuaaaaaauaauguacuuuaagaauguuguuuuaaaaggcuauuucuuuucuuuuuagccuuuggaauugcuuuggcacucauuggaugaaugguuaguuuuaauagccacagaauuaaugaaaaacaaagaggauucaacagauauuacuucuaucuugcugaaacaaaaaggccaggaucaagaggccccuucucuuucugcauuugagccaccaggcccugggagcuaugaaagccugcccccugguccaggggacuccaagccagaggugcuugcaggggagcaggaagccagugccgacugucaagacgucaucucugugacagccaaccggcugagugcugucauucaagccuucuacaugugcuguuccugucagaugccuccaggguaagauagucccacuuagucugauuugucuuuggugagugaagaaaagcuucaauuuguaauuucaggaaagacaaauauaauuuuuuuaaaaguuuuucuaaaagguccuauucacauuugucuuaggauacucauuguacuaauaaaaaucugguaaaaauauuuacauuuuguaaaaguauauauauuuauuuuuauguaaauuggugaaugcuacuucauaaagaacugcauuaaauuuuacaauuuuaauagucacuuguuuauauaucauuuguuaauaacaaguuacauguaauauuucauuguacagacuccuaaguugauaagaaggauguauauguaaguucuuccuuccugucuagaagccaguucuacuuaauuuacuggauuugcauacuauaucuccaacuuuguauauucugauugcuuuuucccucccccucagaaugacuucaccucguuucauugaguuugucugcaagcaugaugaaguauugaaaugcuuugugaauagguaaggcuuuauggguaagggauaugguaaggcuuggacuaucuuggcagccuuuuuucuauuuauacauuuucacuuaaacagauaaaacuaauucuguacuauucaaaauaguaauuugucauuaacaaaaguauagcagguagagauuaauauguuuuucuuguacuucagcauuauguaucugaauuugcauuuuacucagugauaauuauuguuuguuuuauuuuucuauuagaaaccccaaaauuauauuugaccauuuucacuuucuucuugaauguccugaauugaugucaagauucaugcauaucauaaaagcacagguauagacuuuauucaucuuuacuguuaauacagggaaaugaaauauuuuuuaaauuauuuaauuuuuuguaauuuuuaaaaauuuaaaauuuugucauuuagaaaauacuauuuuauuauguuugugggcauggguauuuugucguguaccaugugcauggcuggugucucuauaguccagaagaggcaucagauccccuaaacuggagcuauagacugccacguuggugcugggaacccugcuccucuuaaccucugagccauuucuccagaccuucgaaaugaauuuuuagauuuugaguuuuguuugguaauuuuacuuuaaaauuacugcauuaaagauguaacuccaugguaguuuaguaugagaagugaauugucuucuucgaggaauguguauugaguaccuacuguauacaaaggcauguacagagcuaacagaauacauugccacacuuuuaaauuaguuuaauuaguuuuguaagaucuuugaggaaaggauuuucuccccaaauauacuuaggaaauaacaccuaugccauuuagaaauuuauaaaacacaucagcaauauguuaaaggacucuuaaauccuuuugcaaaaguagcgauuuaacaugacaguucuccaaagugugcuugauuuggcagccuuuuuucuacuagguguugucuguguuucaugaaauaugugaaguacuuucauuaagaucacuuuuuugcaaauguuuacugaaaaguuagcacaugaaugauugugauuuaaauacugauagcauuuuacugucguuuuuugggguagccauuuaaagaucgaugugagugguucuaugaacaucugcacucaggacagccggacucagacaugguccacagaccagugagugagaacgauauccuccugguucacagagguacgugugugucacagagacacugauagguggauaagccgcaaaguguuguuguuuuaagucauacuauauuacaauuaaccaguacuacauauuuagauucuauuuuuaggaguagcugugaaauuguaucaaaagcaaacugugcaaagcuaaagcaggggauugcuguacgauuucauggagaagaaggcaugguggguauaaacuauaacucacuuuaaaaguugaaugcuuaccugagaguaucacuuaaauuuuguuauuauuuaaaauaaaaagacuaaauaucguuuauuucuauuguugcuaaauuugguuuucuucaauucagggucaaggcguugugcgugaaugguuugauauucugucuaaugagaucgucaacccugacuaugcacuguucacccagucagcagacggugagugugucggcuggagcuugucuguggcugucagaguccucaaacuguagcagagaauuugaucuuuguuucuuugaauagcccugaugucuagguggguguucccuugucacaggagaaaacugaagucagagugugguacucauucacauagcuuucuucugaucauucgguuuucaaaugcuugucucagggccucaaaaguucucuugagaaccuuaauaucuauucacuuucaggauuguuuguuucugucuuugacugcccuccuguacuauuauuuuucuuuaacauuuucuuuuauaaaaugguaguagauggacuuuaaauacaucuuuauuuggaaacagaauuuugcuaacccuauuugcauuucuguuguaaaaucaugaaaaucaaagucuaucaugaaaaucaaagucuaucaauugugauguccuucuuacuggcuuuauuuuuaguccuuuuaggagaucagacucggggaacugagaagcuuguacauagcccugaaagcugauggacccuuguggaaaugguucuuacagacuauauaaagauaggauuugauauuguaaacuaaauacuagugguuacaacucauuuugggagguguuuuugagaauuaucuaacuuaauaacacauauuugaagugaagguggggcugaaaaauacuauuuccccaguguuugaaagaagagauuaucuuucuaauuacaacuguugacggcugcaacuaaugagcagcacaugccuguguaaggagggugaagggaggcacgaguggggaggcacaggcugugggugugcaacugugcgcagugucucuggcacaccugcaguaauuaaaguuacucggggaugugggacugccugguucaaccuuugaucauuuucugugaggcaaauuugguguuugugauuuuuaugacaagcuuaauaaaauaccaagcuuaauuacauagacauaauuuuuuaaagcuagauccaguguauuuuagucuucuuuucuuuauaguuccuuauucugagucaguuuaguugcauauguggaguccuuagguguacuuccuaauggugagggugacagcuguguguggacucacacacuaagguuuugauuuguuauuucuguaguugaugugaguuuucuuggcgguggcggggcagggggucaucauaguauuaguaacuuaaaacucagggaaauaguccccguuguaggcuugauuguccugaagggauuaaauucaggauuuaagaauucaugauguggggaauguuagauaaacccaauauuuuauaguauugcaagauuauuuucuugucagauuaagaucaauauacaauguaguuuagugguuaagaguuuggcuuuugcagugauggcaggugugaauccuggcucuggacuuuccuuucugugaauauugggacaggaacuuaaccuuuuugagcuucagauuucucauuuaauaaugaugauaaucugugauuuagaauaagaauuucguuaguugauacaugaacacagcgcagccccuggcacauggaaaaugugaaguaaauuuuagauguucuuacuuuuauuuucagaauauuuuccaauguaguaggguuucccuccugaaaugauguucacuauuucuugaaaacauuuuuaauaaacauauuuuacuugaaaaauaaccaguuuuuaaauuuuuuacauuguuaaaaauuauuaauuauguuuauguauguggguauauucaugcgaguggagaugauuauggaggacaaaggcacucccuggaagcuggaguuagcagacaugagugcuggaaacugaacucugaucagcuggcaaagcaggaaguucaccuuaccacugcacaucgcuccagacccaguuaaaugguuuuuaauacuagaacuuaagcuagcuggguccacauacauuuuuauuguucuaaguaguuuuugaauaaaauuacuuugcugaagaauuuugccuaugugcuaguuuuaauuuuuuuaaaucuauucuuuuuaagaaccagcauucucaggaacucaguagauaguggaggaauauacagaacugggagaagaaaguagagucaccaaaaucuuugcugguucaucuauaguccaaguauuaucacauacguagguaaaaguauggcuauacucauacuaucuuuuggaguuaugguuauguuugucuuugaagucuuuuuuggcugucaacaucuccucuugccuugcgauaggaaaucauuacgagaggcaauuuagagugacugguguguuucacaugucuauucaucauucagucacaaacaaguuuccaaaucuguuccuucgaaccuaaguaaacagcaguuuaauccagccuugcacuagcaaaucaaaagccuaugaaacagcaaguauucaaggugucuagacacucauuuucuaauaccugcccaguuuucuuuggugcuguuucauuaauuuuaucaguuugucuuuguuuaagccuuguuuuucaaauaguaguguaaagcacaaacucaauguauauucugcucuaugaacaaaugaauuuguaauucacgucaauggccagaaaaaguauugaaggggaguuaaagucaagguguggcuuuagauuucacuauuuugcuaggucuuuuggaaguuagugugucauuuugucuuucuccuccuccuccucuucuucuuugguaaaauauaaaauucaccacugaagacauuugaaaguagaucguuuguuagcauuaaguccuuuugcuaugcucugcagucaucaccaagucuaauucuggggcugucccaccagccugaggagaaacucuguaccuuagauucagcuuccucuaccacuaauuuauugcgccucuauucuaaauuugucuauuccauauaguucauaaagauggacuguaucacgcuacuacauagguuugagugaucauaugguugcuguugucacuuucacaucauugguaguuguuuaaacuugauuauuugccuuuugagaguaggaugaguuaggugggcagaguucccagucauuaauugguauuaauaggcaucacauucaguaaucaaauuacuuaagaaugguucuuuucauaguuuguguaucuuaauaugcaacaucuagugaguacugggcauguacagaugaaugaagcagugucugucagauuuauagcugaguaguuacugccacaguuccuagaaaaauguuugcauauguguaugaucuuuuauuguguuuaccagggacucuuuggugucagucagaaguauuuuaugacuuccucucaagugugaacugaugaucaucuuuuauacuuccaauucuacugucuuucuguagauuaugcaaagaacugcaugcuguagucugcauaauguaaccauagccaugcugagugaguuacaugugaauaaaguuaccugcauuggaauguucuuuucugcauauagaucuuacuguccucuauuuauuucaauaggaacaacuuuccagcccaacagcaacuccuaugucaauccugaucacuugaacuauuuccgguuugcuggacagaucuugggguuagcuuugaaccacaggcagcuggucaauauuuacuucacacgaucauucuacaagcacauucucgguauggauguacccucacuucugaagacauuuacauugcuuuccuugcagcuuuuagagagaauggauuggauaagugccaguuuugccauuucuguugaaauaauuacugcucugauaagagaccaucuguguuccuaaaguaucugggggcuagagggagagaaaaaugcucuaccuuuuuuuaaaaucacuuuuuuuuuuuugcauuuccauuuuaguguguauguguuuauacaaagcauccauuuuuuuaugcauauaccuaaaguaauuggcaauucugaagcuuauaacagcuuccuaaauagcuguuucaaagaaagacagcauuguaaagaugaagaaggaacagcagcuuaauuuaauggacuucuaaauuuagaaauuagcauccauuuuaaacaugcugcaaauuugauuauauuuugugguuuuucagaguaucuguagagggcagcauuucaccauuaaaucaguaaagggaagucagaagugccuauauuguaacugcugucuuuucaauuuucuuuuuagguauuccuguaaauuaccaagauguagcaucuauugauccugaauaugccaaaaauuugcaauggauuuuagauaaugauauuagugacuugggucuagaauugacuuuuucuguugagacugauguauuuggagcuauggaagaggugccuuuaaagccuggggguggaaguauucuugugacacaaaauaacaaaguaaguauccagauuuuugccuuagucauucuucauaauggcccugaugccaguuucucuaaauuauuccagcauuugcuagaaaaacuuacuuugucauuugcaaguagaugaaaguacuuaaguuaagcaaacuagcauauuuaagacuugaguuagaaagaaucauuuuaguuuaguacuaugauguguugguuauuuacauaauuuagacuacuguuuagcugauuguauuaguuaagcauuugcauuuugaaaaaguugauuggaaauguauacuaagugaugguguuaucaucacuuaguuacucaguauuguauaguuuaaaaguuagauauucaccagaaacuuaggauacccaagauauaaguuaccauuugcaaaacacaugaaacucaagaagaaugaagaccaaaguguggacacuuugccccuucuuagaauugggaacaaaacacccaugaaaggaguuacagagacaaauuuuggagcugagacgaaaggauggaccaucuagagacugccauauccagggauccaucccauaauuagccuccaaacgcugacaccauuguauacacuagcaagcguuugcugaaaggacccagauauagcugucucuugugagacuaggccggggccuagcaaacacagaaguggaugcucacagucagcuauuggauggaucacgggcccccccaauggaggagcuagagaaauuacccaaggagcuaaagggaucugcaacccuauagguggaacaacauuaugaacuaaccaguaccccggagcucuugucucuagcugcauauguaucaaaagauagccuagccggccaucacuggaaagagaggcccauuggacuugcaaacuuuauaugccccaguacaggggaacgcuagagccaaaaagugggaguggguggauaggggaguaggggggaggguaugggggacuuuugggauagcauuggaaauguaaaugaggaaaauaccuaauuaaaaaaaaguuauucaaaauuuuuuuauuuguauguaugugauaucugcauguaugugaguaggcgugucuccaguguggaugcacauggaagccagguauuggcaauggguuauuuuucucaguuguuucuugaccuuuauggguaggggcauuuuagcaguauuuauugacacuuaguguaacuacauacuuuagugugacaguugucuuagaaacuuauccucuggggacacguguauaggugcagguguauguaaaaguucuccacagaaguggguguggucugagaagcagguuacauacugcaguugcugugugacaugcuuucuagaauaccuugcuaagugagagagugaguggccagggaaugugugaaguaagugcaaagcucuguggaggggcauuuacucacucauauuuacagacaccuacagacaggcccgcagugacacaggggagaucuucaacgagauccuuccugugucucuugagucauugacucaauccugguuuugcuuguucugccuuauuuuuccaugagaggcaggcaguaucucucaugaacaucauuuuguucuacacugccuggccagugauucccggggagucaucuaugugugucaccucaaaggcugggguuacagaggcacaccucuguucuugcccuucacguggguuccagagaucugaagcugauguaucaaacacguuacucccugaaucagcuucuccgcaccagguuagagagucuuaacacagaaaagaaaucucaguguuaaaacuuuguaugugcuuuuauguuccaguaaauccuaccucuugauuuccuauguauauaauacacacauauaugauuuguuuuuauuauuauguuauauauuugugguauuuguuuuaaaguugacuuaaaaaucaaugacauuuaauauuuuacauugcuguacauauuaaaaauguuacagacuauagauuuauuaaaauguguaauauuuguaaaaggcucaaagacauggucacauuuuuaaaaaguaccuuuauucuucgagaauuucauguggcauauuuugaucauauuuucucacucuauuccuuccagauccucagguuuuugcccccucuuguuuuuuaaauaguucacugagaucaauuuugccaucuauuuaguccuuuacuucaggguguagggccaucuaguggagugcggcccacccaucaggagccguauccuuacagaagacugauugcucccaccucacucccagcccccaaagccaucaagcuacaauagcuccucaguugggugguggcucauaagcccauuuucaucuguauuagaacauugguuggcuuggucuuauauaggucuucugcaggcagauacaacugcugugaauucaugaguauagugguccugucauauccuuaggaaauggguucgauuugauuauaccugcccuauggcucuuacaaucuuucugccuccugugauucugcaccuuaggaaggggugugauguagaugucccauuuuauggcugagcacuccacuuccacuagcugagcaccuucaccauuaugaaguuccauguuaaacaccagccccugaacaaagacuucucugaugaggcgucagagcugcacuagucuauggguagagagugauguggaaguuagagggaaguuugauacuguacccauuucgcaaaauaauguaauagguucauucguggggccugugagcuccccagugauggacucugccagauuuacagaaaccaggcguguguuuccuucuguggaguggacauuaauugcaagcagaaacugguugguugcccccaugacaucuguccuaguauugcaccugugagcagaucuugucaugcugguauuauuacaguuugcagcaagguucacaguugagaaacacugaaugacucuuaucccccaggaacaccuucuacuuagcaccuucuaguuuuguaaaagcuaaccagcaagagggagucagcauaaacuugauuucgcuguguccugugaucaauguguauagcaucuucagcucgggccuuagguaaaaccaagagcaauuaccauagccuguauugaaaacacaucucaagggcauauuugaccauaacuugaagggaaguauccaguuccuugcauugaacucuuuauuugucaauuauggccacauuuuaaaacucauugucuucaggauucuacgauagagaauuguuauuaacguuuuugcuaagugaaaaucauucaaaaugauuuuggaggggauuguagucuaaaaaguauguccuuaguuucacauaauuaugaauugaaaacuuuaagcuuuauguauuuuacuuacauagaaagaucauguucaguuauagguaauagaauggggagcugagguuguacuuauuuuuaucuuccauguggauuuauauacaagacauggaugccuaaagaaugaauggugaucagagugugaugccaugaacaugguggcugcagucggccaacucugggacauggugggcgauuggguaacucuggucagugccgggugagagaagcagcuguuucaguagugcucguacccacaauucaaggcagcuggccauuagggcaagugaaugccguagccauggcuuaccucuccgggauauggagcccacagaccccagccccaccagggcuuucaucauguaugugcugcuggcugggaugacucuggacauucagaaaagguucugauguggcugucaagggagguguggcccugcuucugggccuguaccuggccacuguaggcagugaacugaguaccuuccaccucuugaccuacagugguaacaggugggugggggugauccucagugugcucccagggcugcucuucagccuugaugccuauucuguggcccuggccuggacaccacccgugcuauguacuucauugugcauucguugcugacuacagccuuggacccugauagugugggaugggggcaguccucagcaacaucuucccuucucccugaccccagaacagccacuuuccagccccucaucauauacuggcugaccucccauuuggucuggugacccuggucacugacccgggcggcacugauuuuuccauauauugacgauuugguuuccuugguggguggguagguggggaaugaauggcaaacugguaccaaagucuaagccuccuaaguucugguucaguggccaucauccugugugcaacaggaaugauauugaagaagaacuuuaauuuuuaaaaauauaaugacucaaguccuguuaaucuauaagucaaauuaguaaagacaugaaaauaauaaacuacuuguauuuuuaaaucuauaugagcuuaaugauuuaaaaaauuaaauuuaccauuauuauugcuuaugugauguguguguaggaauguguaccuuccauggugcgucuguggaggucagaggacagcuuugcagaguugguucucuccuuacgcucugugugguucucagggaugucugguuugugcugcaagugccuuugcccucugagcccucugaauuguaggcuuguccaccucgcaucacguuacugcuuuaguucauacugaaggccuacacucaguaggacugaagcagagucuuugcuaaacgggugaggacauuucaacagaaccugcaggcauuaaccauagcucuuaaauacggacacugcaccugcugaguagguccaccgcuccuuucagauacauguaaugugacaaaguagacagauccuuucaugcagcucuaugcucuucagcucugggaaugugagcaucuucuaguagccccuuccacucauacaugaguuuuauuuagaguuccaaaauauuuauuuuauuauuuugcauuuaugucuuuugaucaaagugauacauuaaaugauaauauguucauguugagggggccauucauugggaaugugaaucuuauccaagguuggaauacugugguaauaaggaccucaaaacaauuuaacuaguuauuugguugcuuacagaauuuuggcaaaaugguaccaaagucuaagccuuugugauuaggauugggaaucgcuguuaauaacauagaucaaucauuaguauuaguauaaucuuuuuuuuuuuuuugagauagugucuuuucuuuuuuguugcugugaagagauuccauggucaaggcaauuuauuaaagaaagcauuuuaauugauggcuugcuuuuaauuucagaggguuagagucugugcaucauugcagggugauggcaucaggcagaaagcagguacaagaguaguaacuuagagcuugcagugugaugugcaguuggugugugugucugucuuugugugugccucugugugucugugucugucugucugucugucuguacuggggauagcuugggcuuuuggaacucaaggccuaucccugguaacauacuuccuccaacaggccauaccucuuaauuuguccuaaauaguuuuagcaacugcagacuaaacauuaaaauauaagagccuacgaggccaauucucauucaaaucaauuuucuggcguauaauaggcuagucuucaacuaaccgugauaguccugccuucccuuuuuucuguguuagcauuacaggugugugaugucacacuuggcugauauguaaaaucuuuaagguauaacacuucuuaaaggagucauuugccuuaaaauugauacuagcauucacaaagcaaagauuggaggcucaugaccuccaacuggaguguuagugugcagcaguaguggguguuugaaguaauaguugucaagaaauguugauuuuuacuauuuauucuguuugaaguuuuacuucuuauaaagagauaaggaaacauuucaaaacaguuuggaguuuuucuauuaaugcaguuucugucaaagcaauucaaaguuuguaaugcuagaauuuuauuauucuacugaaaaauaauugauacucaaauacuuuugacauuagugugaaaauuggcauaugaaggagcugauauuuacaaauuagcaucugguaauuauggucuggauacugaaauuaauguggaaaaucauaguagaaggaaaagaagaaacugugaggaaagaaugguauaacuacgagaaccaaguuaaacacugaauguguggggauagugcucuccugauauaucuggaauccagcuaaguaggcagaguccaauugagcagugcagaauaguuucaugucucccauuaagauuuuucuuguguacauguguauguauguauggauauugucuauguacaugcauaguguaggguaugugugcaugggagccuuagucccuggagacagcaucucuuacugaacaggagcuggcccuagugauccuuuuugguuacagggccagcuuuucauuagugugcugggaucagguccucauauuugcacagcaaacccuguuacccacugagcuacuacuuccauagcgugaaugcuuucuaauuugauaugguuucaaacaguaguuaucaaauaacacuuuuaagauaacaaaaucaaaaccuuaacaagaaaguaauucuugcuuaggagcgauaggauguuauauagcaucuuaagcauguuuuccucuuuuauuaauaaagauucuuuuuuauacauuauauuaugauuacagcuuucccucccucugcuccucccguuuccuucccacguccccucccuugcugacccacucccuuucugucucacauuagaaaagaacaggauucucagagguagcgacaaaacauaccaaauaaaauacaauaaaauaaaacaaaugccaucacaucaaauuuagacaaggcaaaccaacaaaaggaaaagagccccaaggcaggcacaagaaucagagacccacucauucacacucccagguggccuguaaaaaucuaaacugaaagcuauaguauaagugcagaggaccuggggcagacccaugcaggccuaguucuugcugcuucagucucugagcucacaugagcuuuguccaguucauuuagaggaccuuuuucucuuggcuucucaacucuggcucucacacucuuucagcuuccucuuucucaggguucccuguaccuuaagcauauuagugguauaaauaguaaaugagucuggagcaugguaaugcauucagugaacaguuugggugagaguagacaugaacuaaacgaugauuggaugcuaguaaggaauugacacuugugcuguugucacuggcagguguuagguagguaugugugugugcaugcuuuccuaggucaaauccuggagauuuagaauuuauuacuguuugauuguuaaauguuaaauaauggccugauuaguuccugaauaauaccuuugaguauuccuguguaauacuuugaguagcgggcaaguaggagucagggauauugguggauuggaaacagaaguggcuguuuuccuugugccagguuauagaaguugccaaaugugcucuaggaggaucaugaagaaccaaucuacucuugacauuucuguagccucagaguuauggaaaauucagaguauucagucuuguauuaacauacuggcucagugccuuugaaaguaucagauuagugccagaaaaacagaaggaaacuaaagcaaacauguuugcuuccucuuacugagguaaaaacucaaagaaacuugggagaugaaagguuuauuuuccucacaggccaucacugagggaaaucaggcaggagcuugaggcagaagcugaugcagaccacagaggaauacugccuccuggcuugcucagucugcuucuuauaaacccuaagucaguguucccagagcugguaccccucaagccucacagacauccuauuggccagucugagggcaguguuuucucagucagcuucccucuucccaggugacuugcuugugucaggcugacagaaaccuaaccacuauuagagcaggcuuucuuuauuuuguguguagagaaaucauuucugguuguugagaaguauauguaguauuugcaucauaauuuuaaacaaaaaaauugacuuagaagcauuuauuuaaagaacacauaaaugaccaaacaucugauacuuugugugcacauaugauaauuuuguaccaaacacauuuuuuaguacuugcugaauuuuaagugagucugcuuccugugaggaaaaugugguuuaaaauaaaaugcauuauaauucuaauguuuagaaaacuaaggcagaaagauuguagauuuaagaaaauccuaggcuacuuagugagaucuauuucagaaaaaaaaaagaaaauuaagaaacaauuuaaaaaguagauaaaauaagcuuuuuuguuuuguuuguuuuaauuuuggcuuuuaggacagggcuucacuguguaguccugggaaacugcucuguagaucagacuggccucgaacucagauuucuacuucccucugccucccugccucccugccucccugccucccugccucccugccucccugccucugccuccaggugcuaggauuaaaggaaugugccaguuuaagcuguuuuaacucagaaucgaguuggcuguaauuaaaauuaacuacacccagaguauuuugguggauguaugcguuuguuuuauaacauuuauugaacauaagguagcagcucuuuuuuuuuuuuuuuuuuuuuuugcacgugggacuauaugcugauaaaaccuuugccuucagagauguuacacucuaaugaaguauuuuggucaaaaagaacuggaaguuuaaagacauugaggccuaagcaggcuugcauuuagagauuagccauaaggccaaggaaauuaaauguugcuuugcuagcagcaaaggucgagggauuauuuaggacuuuagaacuagagguagauauauuaggaagucaggaacaaggguggaaugaccuuaaggucugugguguaaaaccucaaguccccuguggcugugcuguggagacagcaguucagagcuacagaugggaauagggacaacaugugccauaauccugguggugugugagagaggagaggcuguagcagggccagacagagagugugcaucaugcccccauacagggcacucaggaagucauggggauaguugcuaagauacgggcuggaugucaauguguuuacugguuugcugaggagugaguguugguguuagguuacuucuaauuuugucucuuaagaaacaaaugcauccauucuggcuuaacuguaugagauuuaaaauguaaucaucagaaaacauucuuuuuuauaggcggaguauguccagcucguuacugaacugcguaugacaagagccauucagccgcagaucaaugcguuuuuacaggguuuucauauguucaucccgccuucccucauacaacuguuugacgaguaugaauugguaaggaagagcauguucuuucucguacgccagagcgcaacuccaucugaggucauucagaagugcuuugagugcuaggaugcugcuuagucguggaacgcuugcuugccucacauuagcacacagaaggcccuggguuucaucccuaguaccguaaaaaauaaaagcagaauuacuaaauucuugaguacugaaugggauauuuuuaauaagacauuauuguuuagagcuaugcauagaaauuuguaagcagauauaugguuuuacuugucuuaaacugaguagccuuauuaagaguucccuuagugaaauguccauguaugauggagaaaaaugaaauagaguuuuuaauggcuuugacaugggagauguugaaguccugucuucccagaagcaauguauucuccauuguuucugaaauuguaacucguuacauggggguaaaggauacuuaugccuaaagaacuaggacaggcuuuucuuguuguauuuauguaucuucuccaguguuuguuuuaaugugugugugugugucugcuguauaauuuuuauaauucucuauuuccaugcuuuguguagucuacuuucuuuguugaagugcucagugaauguuugguuuuguccuucaauuugccugccuucuucugugaccuaacagaauuuauaauuuuauguuaaugucuauuuuuggcucuuuccuuuuucuugucauuaauaaauuauuuucaaacuucuugaucugucuaaaaccuuaauaagacacaguauuuuacuuuucuuauuucugugacaaguaccugacagaugggagcuuaagggaaaaaagguguauauaauuggaucgugguuugaagguguauguaguuagcucguuuugguggugaagguauagaggaggggcugcuccucacugugguaguaggaagauuaaggaaggaugcuugcucacaucuuggcaggccaggaaggaaaacaauuagugacagauugggcucaaaguaggggccuuauccaaaugcuaaagcuugcucccagcugcccaguuacuacagcugaacacuacuuuuuaaagguguggggaccaaaugugcaaacacaguuuguggagggcauuuuaaagucaaaccaaauugcuuuauuguguaaaaaauaauugaaaacaauucuagauaauggaaaaaauguaacauaguauagaauaacauuuuuuuuucccuuuugauaaagagguuuuauuuuuuuuuccauuuuuuauuagguauuuaacucauuuacauuuccaaugcuauaccaaaagucccccauauccacccacccccacuccucugcccacccacucccccuuuuuggcccugaaauuccccuguacuggggcauauaaaguuugcaaguccaaugggccucucuuuccagugauggccgacuaggccaucuguugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcaucuacuucuguguuugcugggccccggcauagucucacaagagacagcuacaucugcguccuuucaauaaaaucuugcuaguguaugcaauggugucagcguuuggaugcugauuaugggguggaucccuggauauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucugggucuucaauuguauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuaaugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuuuugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuggcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuacagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccugccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuaucuguagguuuggucuucucauuguguccuggauuaccuggauguuuugaguuaggauccuuuugcauuuuguauuuucuuuaacuguugugucgauguucucuauggaaucuucugcaccugagauucucucuuccauuucuuguauucuguugcugaugcucgcaucuaugguuccagaucucuuuccuaggguuucuaucuccagcguugccucacuuuggguuuucuuuauugugucuacuuccccuuuuaguucuaguaugguuuuguucauuuccaucaccuguuuggcuguguuuuccugcuuuucuuuaagagccuguaacucuuuaccagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauuggggcaggcacugugguccacucaccagaggucuuagggucccguggggagucccgugugggcccuugcggguguugggcaagacucugcuggcaagguagcccggggcucgagucucgagucgagcggaagggcuagaauaacauuuucuaauuaguguaauuuagaaguccauugugccucaguuuuauugaauuuaaguuuugaagguuuuuuuuuugucuuauuuuagcuauaagauuauuguuuucauuuaacauagauauuuuuucuuuguuuaguuuuaugucaucauuagcacuuaaaaacaaguaguuacuugagaggcagcagcagguuuaucucugagcuugaggcccgccugguuuacagagagagccucaggacaacaaaggcuacacagagaaacucugucucagaaacaaaacaaaacaaaaccagaaauaguuaagaauuguuuguggacaugacuggaaccugaauuuugauguauuauacuucaauuaaauuagcuuugugacauucaagacagaauguuaguuuuugugacuauguauaugaacaaaguaaauugcaauagcagaaauaauugacaaaauguugcuuggugauuugcugauauucauagaccaugaaagcuuccaauuuaauuauauauauguuaguaaauuaagaaauauaucaaaccagcagccagauuaagugauaaaaacccuaccacucuagauauuuuuuuuuugucuucuggucacugucccucauggagaagaauuacucucugaguacuauaaucauagcuuuaacuauuuguaaaagaaaauacuuauuagcauaguaauggguuucaucuuauuuccauacauguacauuguauauuuugaccaucucucccccccccccccccauuauccuuucuuauccccccacacuccuguuuuccccuuugucucuccaacuggccuuucuuuuuccuguuugguugguugguugguugguugauuuuuuuuuuuuuuuuuuuuuuggugacccaaaauuccuuaagacuguaugcaggugcuuaggcacuuauugguagcuacacccugcugcuaacugcagacacauuccaaguaagaagugggauugguuccaggagucuccacacuccaggacaggguuugggauggcccaaccauaugcaggucuugugaguuugacaguuaggucaugcccagagcuaagcaguccacaccacuacucacucuguucucuggcucuuauauacccucuaucccuuuuuucuuguuucccugggcauuggaagaggucauaaagauguacuguuuauggcuagacucacucaugcaauauucacccauggaucucugcagccauuguugaugagggcauaaggaagcuccucugacuaacacuggcaguagcacuaaucuuacaggcauaaacaucgguauuuagaaggcaggaugaugggcguaucccauccauuuacuaagcuggccacagucauuugucuccuagccacaguuggggauugguuuaauaguaccaaaugugaauuccuucuugaggcauggaccgaaaacccagucacaaauugguuagguguuccuguaggguccuugcuccucuuaggagguuuaugccacacuaucaguguagaggccagagggcaacuugugagauuugguuuucuccccaccuggcuggguuccagguuugaacucagguugucaugccuggcagcagguacuuugaucuguugagacaucuuucuagcccuugucauuuccuuacuuuguugugucuauguguuauuggccucagaaugauacagguuuguaaaguaaguugauagcaccucccccuuuacuguuuuauggaauaacuggagaaagguuggaauuagaucuuuaaagggugguagaauucuguaguguacccaucuggguguacacauuuuuuauuuggaagguuuuuacuuucuguuuucaucuuguuccuugugacauaucugcuauauucuuuaucucaucuuauuuuaacuuugguaugucauuugugucuagaaauuucucuacuucuucuagauuauccaauuuaguguacuauguuuucaagguaugucuaccauuuucuggauuuuauugguaacugcuauaaucccuucuuuucaacucugauuuuacagcuugaauauucucuuaguuuuaccaaagguuucuuuauuuuguugauauuuucaaagaauugacuguuuucuugauucuuuguauuuuuagaacuucuauuugaauaauuucugccaugauuagggaccuuauuuuuguauuauuauuuuuaacuuuaaaaauugugugugugugugugugugugugcauguauaccugugugucugcuugcuguagugugcaugugugugcauacagaggucagagauuuugugagaguucucuccauuuaccgugugggcuccugggacccacuuggauccuaaggugugguagcagaugccuuucccuccucugcuccuuucuuauggucaaauagaauacaaaaaauuauuucaguuuuguguguguguguguguugagacuugcuuuguguucuauauaugaucuaucuuagagaaaguucuguggacugcuggcaaaauguuaguuucaguguuuggaagucauccacuugaucuaggaugucaugcacuucugaugcuuuguucuguugauggccagugcugugcaaccggcccaaggggagaauuuuacuugcuuuucuacuauuggcugcugcccuuaauguggcuuuuuuuuccccuagcuguuuagaauguccuuugauuuuccaauaccucccuauacuccagcuuucccuagcuuauuuucuugagauuuuggcuaaguauaccugaauguugccaucuguguuggauuuggcagguuuaucuauuuugaaaauaaauguaaauagaaaacaaaguguuuugugguuaucauacauauugccgcacacaauuauaauucacuggcuaguacuuuacuaugucucuuuccuuuugucuuuuauacuccugaaccuugacgggggucuuuacaguucugggguacugaacuaguugugcuguaguuuuuccucaucaaaauaugugcguauguuuuauguauguggaguuauagaacagggauaugcuacaucaagaaaaaaacuuuuuacaauuuuguuuaugugaggaggagaaagcauauaguugcucaagaucugguaucaguuacuauggauagagagcuaaagcaguggccaagguuauccuaacauauauguaagcagugacacuuggaaggcuuagauguccaaguaguuaucaucucauugugugcugcaucugugaugcuggaauaccaaaacaccaagucauauggauucuaggcauucuaauuucugugacucugguuccauuaguguggccucuauguuuagauuaugugugcaucugcguauaucuacacauuuguaguuuuuauuuguguuuagagguagaguuccaugcagcccaagucggcugagcucagccgugcuguguagcugagggugacucugaacuccuuccuucugucaccucccagagcugagauuacagguaugggcacugugcccgauuguuuguuguaucuuaaaaguuuaguucuuuuaguauauuaagaauaaauuauugucuaguugugguaguacaugccuuuuaauaccaucccucaggaagcagaggcaggcacgucucugaguucaaggccaguuaggacuacacacagucagacccucucccaaugucaagaaauaaauuauuggaauuuaauaauauuuuugcuauauguacuuuuuauuuugaauuucccuuuuguuauuugucaucuuaauaacuuuucguuaguuauuauaggaauuuaaagaaaaaaaucauuaaauguuacggcucuaaugguggugguaccugggagaauggagcccauaaacgagguggacuaaaguuucauguaaaguuccauguuuauucagagcaccagacaguuuauacucugaggguuaaggcaugaguaaaguguacaacagaagggcaagucacacauggcagacaagccucaugugacaaaagguuuuuccauagagcuguauaaacaaauaacaauauccgguuguaaugaauaaucugaaauaaacucaacuccuuuccacuacaccugggaggagcauaaaaacacauuccauguaaacaauuuuuaaaacucagaacaguuuuguguuuuacaggaaacugaggucacaagacucuugccuugguuucuuggguuuuucucacaagcacucagaagucuccuuauacaacuccuuucugggucauguucugacaauaaaauaauaaccaguguuuauuaaguauguaaaacaaaaaacaacccccacaaagagguuugugggcacaugcuacccuuaguuuuuccauggaggcagaaguaaucacauuucugugaguucuaggccuguaguucaaaaaacaacaacaacaacaaaaaaaaaaaccaaaaaucauuuuuccuuuuuccuuaaauuauagaaaauaugauaauuauaaaauaguuaauuucugagagugcaguugcaauauuauuauuccuaauuguuaauuauggaauaauacuaaaagcuuaucuucacuuuaauauuaaaagcuuaucuuuagucugagaaggggauuaaccuggugaauugugagaaacguaaaauucacccaggugcucuuugguagaucugugucagaguucugcaagggagcaguuuucucaguugggucccguaaggaagccuuaacacagggaccauuaaagccguguuuauaaggaauaaagaagagcuggcuaacgugggaagccuuuguuguggcuacugcugaaagagacagcuugaagagauguagugaaggguccugugugagagagaagugucaaggagacgcucuguggacuccgcacuacagaacaacagcgcagaaaccugaagggagcagagcugugggcccugccugugcuucucaguggcucagaucuuaucuacaguuaguaagcaagaaagccagucugcagggagugcagagugugccaggggugcuagauaagaucaggaguuggccagucaugaggcuggcaaggacugggauaugcacaccagcaguucucaauuauaugaucuugggaugaucuccuucaaaacagucuuugcuuauauggguuaguauaccaauguauauuugcuguacuugaaauuaaauuagaagggaaaugugcuuuguaaauuauguuaauguaaaugacauuuagaaauaaaagcuaaucuaagaacagaacaaaaauaaugagaaaaaugacacaguuuuugcagauuugggaugccuggcuauauaucucauaucuagauucucauaucugcuucuguguaugaucaguuguacuucauuauuuggcugaaguauaugaagaaaauccaauuucauauggaaaauauggaaaaggccacucguacugaccuagugaauagacagagugcucagaccuuaccuagauugcuuuugcuagaacauaugcugcccuaguuagguauauauuaauaacagucguuguaagucauggccuugaaguauguucucagacccuguuaaaagacaugcgucauucauacccucaccgcacuguagggcuuccaucugugaaacgugggcugauucagggacacagacacgccuuuccuucucucuucccuggaaaccccugaugaugaacauuuuggcuuuccugauguaacuuuuagauauaugugauagauuucuguguuugaugaucuuggacaaaagcuagucauguauuuaggaguacuaacgauguugcucagugguugugugcuugccugguuauauacaaggccccuaggauccaugccuugcacugcagacagagucacuagaaaauagucuuguugguggugguuguuguuguuguuguuguuguuauuauuauuauugccuuggagaagauugacuucaaaagaucugaauuacuccaaaauagaauucauauuuuuaaaauaaagaaaaaaaugauuauuucuuaaugagcuuuucauuugcauaauauucaggcuuuuaugacauuuucauguugagaauaugaccuggugggauuuaacacauuuauagggaauauuaaaauaaaaauaaacugagccagagggaauacuuacagaauuguguacauagaaaccuuugcugcguaugguuaccaucaauacagacgcugucauucuuuuuauguuuuagaucgcaucaaaguggauccccauccccucaugccauauuugaaaugucacuguggcagguuccuccuuauguagcacuuauuauugaugauaauguagaaacugucacagacguaaaccagguuuauaugggauuaguuucuaauuaaggcaaauuuacuauuuaaauguaauggcuuuuuuuucccccaaggaagauuaaugaaauauuuuucuucuuccccaaaggagcuacugcuuucuggcaugccggaaauugauguaaaugauuggauaaaaaauacagaauacacaaguggcuaugaaagagaagauccaguuauucagguacaaucucucuggagccuagaaugaaguuaaguuugcuauuuaauuuuguaagcuuuucagcuuuauuggauggaagucuacauccauuaacaaaguaaagauuuugcauaaauucuucuuuggggauauugcauaugaaagccuuuugugaaaucaucuuugauaaaugaguuucagagaauaaaaugugcuuuaugaauauugcauggucugugguucuuauaagucuaugauuugcucugaaaugugagcuaaauuguuguuauucuugguagugguucugggaaguuguggaagacauuacucaagaagaaagaguucuucucuugcaguucguuacuggcagguaagaagagcuuuuaugauaacauuggaagaauuuauuguauuucauuucuaaugaccaagacaguaaaucacagagaaaaacaaacaaaaugaagagucauuguucugucuauauuuuagguauuaaacaaaugauuauuuagauguugaugacaaaauauuuauaguaguguuaaaucuuaauauauuuuagaaccugaauuuuuaauaucuuuuuuuuuuguuugguuuaacaguaaagccacucaguuuuuaugguuggacacacgcucucucucucucucucucucucucucucucucucucucucucacacacacacacacacacacacacacacacacacacacacgugugcgcacacauggucuuugucuaucacauaguuuuaguuuggguuucuguuuacaaugaccaaacagcaaguaugagaggaaagggucuauuugacuuacauguccaccuugugguccaucauugaaagaagucaaaacaggaacucaaacagggcaggagcugaugcagaggccaugacagggugcugcuuauuugcuugcuccccauggcuugcucauuuugccuucuuauagaacccaggaccaccagcccagagauagcaccacccacaaugugcugggcccucucacauuagucacuaacccuacaggugugucuacagcccaaacuuauggaggcauguucuuaauugaagguucccugcucucagaugacuuuagcuugugucaacacaugaauacacacacacacucaugugcacauuguuuguacauagcauuuuucucuuguucuuauugauuuuuaaaauguauucauagccuguauuuaugugguauaguuuuuauauauuuuagaauuccaguuauaugacaucaaaaauaauagaugauaguaaacuaguugacuuaagccuuuuuauuuuuauggaauauaucucaaaaauuuuuauaauacaauuucauuuauuucuuucuguuuaugaaaauguagaucaguuauuuucauuaugaauguaauguuuuuuucaaaagucaggaaacagaauauuacuccacuauuccaucaguaguagcuacuauauaaaauuuaauguauuuacuucuuuuuauuuuuuguguauuuaaaaauauuaugaguguuguauuaguuugcuuucuguuguugugauaaaacacugacaacaagcaaguugugggugaaaagguuuauuuggcuuccugguuauagucaaccaucaagaguacccaagagaacauggaugaaugcgcuuacugguuuguucuccauggcuugcuccgccuguucuccuguacaacccaggacuaccuugaacccccacagugggcaguguaugcccaugucagucacuaaucaagaaaauguccuuguugccuacaggccaauuugauggaggcauuuucucacccagccuuguaucauuagauuaauaaaauaucaaccaucacaagugugaauauauaucguauaaauuuaaaagagaccauuauuuucuuacuuuacaaguaauauacaacaauuuuaggcaauuugaaaaaugaagaacaugaaagaaaaugaagaucccauuagguaaucuccaacacccagaugugaccacucugauguguuuauucccugcuccaucuuuaagccauauaaaguaggaaaccaggugaagccauuuuucugaucaggauuuaaugaacuaguaagacaugacuauuaucagauuauagacugaagauauaaaagaaagccuuguuaaacuuguuuuugcaagagugcuaagaaauguucagggauuuaaauaauuuaauuaaaauaauuuauaauuaagcagcauuauauuuucuaaggcuagaucauuuauauagauuauauagccaaaaacagacaaaauaaacagccuaauacuccuaucucaaucucuuaagauagucagugaacaguuguauuauuacucucuauauguaaauuuuaauuuucaaauuuucuuuuauaacuucuugaauuuaguaguguuccuuuuauagauuuauucaguuuuaauagcuugucuguucuuagaucuuaacccuuauugguaaaguuuuccuguuugcauauaauguuguaagaauugaggaguuuuaaugcauguauucuucuggagcauuguauuuauccagaagccuauguuggacuggggauguaucugaaauguaguaggaauuuguccagugagugcauagaaacccccuccgaguuacaccuacagaaaacaaaaggaguguguuaauuauuauacccaggagucuaggcguucagaaagguaucaauauugauauugauggggaauaagaacgggccugcuuuuuuccauuggccaugcaggagauugaacuguuuuguuuuuguuuuccuccuccuccuccucuaccaccacuaccuccuccuccgccuccuuuucuuccuccuccucuuccuccuuuucuuccuccuccuccuguucuuccuucuccucuuccuccuuuucuuccuccuccuccuguucuuccuucuccucuuccuccuuuucuuccuccuccuccuguucuuccuucuccucuuccuccuuuucuuccuccuccuccuguucuuccuccuccucuuccuccuuuuuguuuguuugauuuuaagaacuugaucuguagaucaggcuggccucaaacucagagaucugccaggcucaacuuuuuuuuuuaaauuaaucagcauaaugcuugugcauuugaacuuuguuauaguguguacauuuuuguguaauuuaaauuuuuguccauucuagucauuuaaaagacuaauguuaagcacucuuuaauacauugauauuaauucuacauauauuuuuguuaguuuaucauuuuucuuuugaguuuaacauaaggaguuuuaaagaauuuaaauuuauaaacugaaaauacuaaauuacuguuagcaaauaaucaguauuuuauauagaucuuguauucugaagaaugcauuuacaaaugugcguguguguacauaugucuguguagugucugccugugaguuuuaugugcacucauuugugcagcacacuuucuggagaucaaaaguaagcaugaggcccgugcugucuccuauugcucuucacuuuagguuuugcacgugcuuucucagugagccgagugaggucacugguuggcacugagcucgggaccuuccuguuaggggauaggccacaguguuaggguaucuguuuagaaaaucaucaauuuccuuuagauuuuccaguuuuguacuuuugugauuuuccauuuccuuuagccuuugaaguaagaccuaauguuuuuuuuuuuuuuaauuuccugaguuucuguuguuaugucucccuuuucauuucugauuuuguuaauuuguauauugucucuaugccuuuuaguuacuuuagcuaaugauaaucuaucuuguugauuuucucagaaccagcucuugcuuuuguugauucuuuguauuguucucuuuauuuauaauugauugauaucagcacugaguuugaauauuuccugccaucuacuccucuugguuuuguuuguuucuuuuuguucuagagcauucauuuaugcuguuaaguugcuauaugagaucgcuccacuuucuuuaugaaggcaguuauugcuaugaacuuaacucuuagcacugcuuucauugugccuuauaaguuuggguauguugugccuucauuuucauugaauucuaaaaagucuuucauaucuuuauuucuuuaacgggguuauuuauauccugcaaaggccucuaucaucuucaugagaugagauugaagaucauagugauacucuuagguguguuaggauauccaggguuuguugugguagaagagcuggguucuccuggugucauacugcacuggcuucuguugauuauguucuugagcuugccuuuugccaucugguugucucugguauuggcuggccugauaguuccugggugucccggguuggagcaggccucccaggaggcaggcagagcuguugggugagaauggguaugcuuauucuggauugaagguggaaguguuggcuggaaagaagauggagcuccugucggguggaguagagcucagggaugcuggguuugccaggggccugggcaucucaccuguguguucugguugaaguaggccuccugguagguggguggagugggguggggaucagugugcagaucugcaguugccgguggaaguguggaaauuugauguuuucuagugcaugaaauuaacuugagucagggugagcccuaacuacaguuguucauggugcacaguagaguagggcuucggguugcuucaugcaguaaagccuaaagacagauuucagcuuagauguuagaaaugggagauccuuuggugcuuacuuauucccuuaugcaaggauuaaguucaggaguccucugugcucggcagaguccuacacugagcugcuuccucagccuguccuuucuguuuguuuaaccugcccuucaguuacgugaaggacauuacaguguuuauccagauacugaaacauuaugguacaguuuguggaaagguuggugacagcacuuauagucucaucuugucuuaauaaagucauagucagaauuuugucucaaugaauaaguaggauaauauaacuucuuauuccuggucacuuuguuaauuuuauagauaaaaacgaaaauacauagacuaauaaauuuuacaaauagauacauuccuggccuuuguuuuuggugguggacuuuguuuuguuuuuguuuguuuguuuuguuauccucaugcauuuaugauuuauugaaaagauucagaauuuuuguuuccugaaugacuggagauugaaucuagggcuggccacaugugugguaggccuagugcauuaccacagagccacauccuuuuacuguaucuuuuuuuuaaauugaaaauauauauuuuuuuaauaauguauucuaacuauaguuucccuuccuccagcucuuccuagauccuauccaucuaccaaguccacaccuuuuauuucuaucauuagaaaacaaaguggcaucucaaaaagaaagaauauaagauuaaaaaaaauaacugaaauaggacaaaacuaguaaauggaaaggaaaaaggaagugccaaagaaaaggcauaggaaacauaggcacagagacauucacaucccacacacagaaaauccaucaaagcaaaauugggaacuguaauauauacgaaaggaccugaacaguuaaaaccaaauuaaacuaaauaccugaugacauaagagacagagccuacaaauaccauugagcugaguaugggauauaccuuaaguguggcuuuuauagccagugagacuccauuagagaaaacuaauuuuuuucucugugagugguugugaauuggagguggcuucuggguuggagaugggguaucaugucuacuuccucccucagcacugggaccccaucuggcuuaaaccugugcagaccuugugcaugcagcaacagucucugugagguaauaugucuguugguggaaguucuuuguccuuaacuguucuuaaucccaagagguuuuccucuauauuuucuucacauguuuuauaguucuaaucauagugauguuuuaagucuuuugaucuguuuuuaguuuaucuuucuauaugguauaagguaaugguccaacuucauuagaaauuuuauaacaaauaauccagcugucccaacacaucuuguugaaugacugagugcuuuuccccauugaaauuuuuuggguugggaaugggguauggggcaaugagacaagcucucaugaagaccaggcugccuuugaccucacucuguagcuaaggaugaccuuggauuuucugguucucuucucucuacacccagagaacugggauuuuaggcaugguuuacuaugccugguuauauacaguacugaggcuuaaacaagggucuccuacaugcuaggcugccauuugaacuauaucuccagcacccuguuacauguucuuggcacucuuucaaaaacaacuagacaauguuuggagggacguauuucuggguuguuuuauuuauugcucuguaugucugucauaacucuuaugauuauauuuccauaauaaauguaaaauuaaacggugugcuucuucacacccuucccaggauuguuucagguauuguaaugaacauuuuuucaaaguguguugaguuacauuggugccuguaguccagacugaucuugaacuuaagucuucuaugccugugcuccuggagggaagagucagcagcacucacaaccaccugcaugcugugauuuauggagcagaaaaccuuuuaauucuggucacacuuggcccaucuuaaauuuccauuaaaaauuaaucugaaaauuauguauguaugugugucuaaaaugaaauuuuacucaacugcaaagaauggaaauaagccagagucagaaugaaaauaacccaugacucuucccaugcagaaucuagauuaaaauuuauguauaaacaugcauguauguuggccaugagaguaagcagaguacacgggaggggaggaggucugcaaggagggggcauggaagcaaaagaaagaaggcaaucagauuuauagguaacaugaaaaugggaggaagggcuguuggaaacaugagggaucugcagggaagagagguacacagggccaccuguggggagaaagaggaagaacaaagcagagugaaugugccugaaaagucuguaaugaagcccagcuacucugcaugauagcaaugaagagauguggaaaaguauacauuuaguauuugugcauuaaaugugugucagaauucuaauauauccuagagacacuauagcaugucacuguaauguagucuuuuuccuauuauuuuuuguggugggcucaaacucuugugccuacuaagcaaguauacuugcauugggcuacauccccugcucacuacaauauauuucccccccaggauuuguuuaaucaugacacauacucggacuaauuugaaauauuaauuuaaaauguauagaacuugaaaaguugugguuauauuuucuauagcuauguaccuggaauuaaaauguuuaguuaaugcauuauguauugaauuuuagccuucuuguggucuuaauuuguuuacacaacaguuaaaaaugauauuugaggaagcuagcuugcaguaacuauuugcuguguaagugugagcagcugaguugggcuucccagaaauuauguaaaagcuagguaugcuagugugcgcauauaaccuuaauaccaguggacagaggaggccauuguaaagaaagcgaggagcuuccaauugauucagugagagacacugucucaaaaagcaaggucgcgaacaauagaggaguugccugaagucaccgcuacacaugcaugcacaagguaaaccacagacgaaauguuugcuauucuccauaucccgaaagauacggguaaauacugcucauuguuguuuucucacugaagaacaaaauagagaaaaaaggguuucugccaagaaauuuucacaaagaacgaaaugauuggauuacaacacacaaggagaaaggcuguauagugucucacaguuccagggcagaugacauccaucauggugugcauggcagcacacaggcauuacuugaacaggagcaggaaggaaggccagguuauaaccaucaugacugacccucauugacauacucagugaggcuccaccuccuaacagagguucucaaccuuccuuaaugcugcaacccuuuaauacagucccucauauuguagugaccccuaaauacacaauuuucauugcugcuacuucauaacuguaauuuugcuacuauuaugaaucauaauguaaauaucuauguuuuccaguggucuuaggugaccccuguuaaaaggucauuugaccccccccccccaaaaggauguugacccacagguugagaaccacuguccuaaagguuuuacaacccuccaaaacagggaccauacaggggccaaguauucaaacacaugaguuuauggaggguauccccacuguaacaaccacugucuauuuauucaacaaacauuuaacagcuguaguugucaagugguuuugcuaaucccaaggauagacaucccaguguuacaaacguaaaauaggacauguucaagaauccuacuuuaauagagaggcacacaguugucuuaggguuuuuauugcugugacaaaucaccaugaccuuauauaacuaggagggggaaaagguuuuugauuacacuuccacagcaaagaauucagggcaggaaccuagagacaagagcgaaugcagaggccacagaggaacacuacuugcuuagccugcuuucauacagcacccaguaccuccagccacuucccacaguacugugcuggacccucccacaucaaucgucagucaagaaaaugcaccacaggcuuacuacaggccaguaugguggucucaagauucuucuuuccaaaaaaccagcugugucaaguugacacaagacuagccagcacauuguaaacacaucauguggccaguuaaaaguauugcuagcugaggaagcacagagagguuucuccugggaagcuugcuaacugaacaugaagcaacagacaggaaugaguugggagguucagacucagaaaugcccuucugucguuuuagaguugaauauauuuuuauccuaacuuagaacuuaaaaugugucugucagacugagauuuucuuuccugaucacagcugaugauacaaacucuuaguuccagggucccgcaugguggcuuugccaauauuauggguggaagugguuugcaaaacuuuacaauugcugcugugccauauacuccaaaucuuuuaccaacuuccagcacaugguaaguuaaacuagcuuauucaaaugaauuauagaauauuuuuauucauuuuaaaucaucagaaguaauugcuauauuuccuuuuugauaguuaaaaugucaaauuuauguauauuuuauuauaauagggaagaagaaauaaccaacgccuucaguaauugcauuccauugcucuguuaugguguuauuaucuuugagaagguauuuuuuuuguuaaauaccuucauuaaaauacagaauacauaauuucucuauuccucuguggccuauuccucccauauauucuuccuucccuuccaaauucauggagccuucuuuaauguuguuauauacacauaucaaugaguucauauaagacuauaacucccuauugggucuuuucaguauagauuuuauguaugucaguagggugccuauugguaguggaaaugagucaggaagcucagcccagggaaagaccagcacuccuuuucucagcugcugucgcucauagcuccucagcuagaggucaggcccugagagauuuccccauccacuuugggaugccaacuauuguuggauuguucagguccuguguagggacccauauuguuggaauuuuaugacaggcuccuucccuguuauauauagcuagaugucacagucucacagcagacuuccuggucgucugucucagaaaaucuuuucaucccucuuguugaugcccccugaaucuuacaugcaggaguuguguaguagauauauccaucacuggagaggagcaucccauagucaguugucuucugcacugugacuaguagcuuucuguaaaaagcagcuucuuugaugaggguugaaguguacugcacaguuaccuaggucugugccaagagaccuuguguuggcugugguuccugguaggaaaaaaggucuacaguugaagugagacccaaaggaagggagaugggauaagagggccugauguuggcagugguccagaacaacuggaacccugucugccugacaguuguggucugcgguguuucuguaaugaaaccauaaucaaccauaaucucuccucagaauuucagaacuacaaaugaauuagugguuuagguuugagucaucuaguagggagaaccuugaagaaggcacaaaccaccuaaaacuuaauugguucucacuaauguuaaaaugccggugucauucaguugcaucgacacuuucaucuguaucacccuguuacuuguuuuuaaucuggaaauuuauuucauccgcucauuugcauucugggaggagcugcaguucuucuuaaacaucacuugaggguuuuccaauuucaaugcaaauuugagagaaugguuuuauguuaauuauaagcaguguuuuuacugcuagauaaaacaaggaauuucagagauucucuguuuaauggugguuuauuuuauuuuuuuuuaaagcaucaacaugcucaaguuaccugaauacccaaguaaagaaauacucaaggacagacuccuuguagcacugcauuguggcagcuaugguuauacaauggcauaaugaagccuggaagacucaucugcgacugaugcacaauccagagugacagaaguaauuuaggcagcugucagaaaggcagccucgccucgacccacaggcagagagugccugcuuaaaauucauaacgaaucagguuuucuauuuuacauuucuuuuccauguuuuguuuuucuauguuugugauacaauuagaaaauauaaaaucauaguagacuucauuuuuuaaaaugcuaauuggaaguagacacuuuuuuuuuuagguuucuuuaaucuuaucuaaaacucuuaagacaaacucuuuuccugcauuccaccucugcugugacgcugucuaguugaaagggcauuugcuguaaauuauaugaggacauccagcugguguguucuaucgcauguaaaguaccauuuauauuuuggaaaaauguaaagaauggauuaauuuagauuguguaaagccauaaauauguauuuucccacguuauacuuauauugcaauggguuuuauuuuuuuguuguuguuuagcuuuuuaguauuuugauacaugguauaaaguuuagacugguaugccgaacaacggauaaagugauauauaauuuauauauuaaagcuuacacuauaugaauuauuugcaucuuucugugcucaguuucauguguguguauauauucuguguggucucaguuuuucuuaugccuuaauuuauacug

SEQ ID NO: 12457 - RNA, 68988 nt, Mus musculus
uggauuuuuuuuuuuuaauuagacuaggaaauauaauuuauuucauaaaaauuaaucuuguuacaagaggaaugcuaaagacuauuuacaaguuauuuacagaauggacgaacagggccgggaccguccccugcauaucagaacccacagacacacagccauguccacaccccggcaccugagcucccacccacuugaccucugagggugggaggaaggugcugucucggaugccugggagccucaagaugggggaccagagagcccugaaagauccagggauaagaagggucccugucccucaagggguauggccagaacucagacaccuggccccauugagaagagcagagaggcacauaggagauacaccaacugacugugacucggggacagcaaacaggcacgcccaccuccaguggcacaaaccugggcacagaggucauguccacauguggggauaggugugcguguucugggaggggugcccugaugugccaaguugaaaagcacaggcaugcacacacacacacacacacacacacacacacacacacacacacacacacacaugcucccaaacacacauacuacccaagaugacacagaaauacccugcaggacccagcaacgccaagcuggcuaggaaugggaaggggagaggcuucaucucauuggaggcaggaauggaaacccaacccaacagcccugucuggcucagcucagaguuggcuugaccuuaccugggcugucugguuagagcccuaccccaggcuccagcucuagcuucugugccccagaugcugagcaccuucuaaguaagagucggacuguaagcugggacuugcucacuaagugcucccucaggucccagacaggcagguuuccgaggacgggcaaaggagagagcaugcagaccacaaucaacuugucucuacucgauucucagagaagcgugggaacccaaggggccucguggagcaucccaggauaaaaggacacuuaagcccagagaaagcaguuaugugccugaagucacacagcacagcuccaccuuggcuucccccuucuaugugcgggcuaacagugaccagugagaguaugcccacagggaugagcaucuuuggcaggaggagcugaggacuacucuaugaggcacuguucaccuagaugccaggggcaccuuggucugucucagagccccacuucaggaaaaccagggcagagaugcuugcugggucuguggccaugaaaccugccuccucacagaggccccaacuuucaaagcuuucaggcuggucaagggcaguucagggaagucagcaucucaauaggaucaauaccagugauccuagucccugucacugcccgugggcugaaagggacaagaauucaucccuuccacuggccccauggaacaucccagaaugcgcuguggucaagaguggguauacagcugucuacuuaguuaccuucauaucuccugaccccaguagggagaucagcggguaaaaugauggcuagaggcacaggggugcagaccggcuagugccagcuuagacacagagccacccagccucacccagggagagagcccucccuggaacacccccucccucucaguaagaguuuuggccaucacgagaccaggaaucaccaaacagaccugaacagucucccagaaccacagcuggacccuccaaagccagaggaggccacagaagggcaccugcagggggcuccggagaggacgaaggccaccaggccccagcuucugcuugugacuuuagaacucagggccauggcuaaaacccugucucagcucccugcacagcuggggaaacugaggccuugacauagcaaagccuuucccugugcagucucuuauugaccacacccacacacacauguguccacaagugcacucgccuauggcccaaaucacaagcauagccacucuuagccacauucaaggauaaaagguuuuuuuuuuccuuuucuuacuuuuuuuuguuuguuuuguuuucuuaaaaaggaacuauccaaguaucuggauaauaaaucauuugcguucccuaagaaacugggucuuucuuugcccuuacuguuuuugcucucucacuaccugagucucgcugacuucugaggcucaucccccaccccccacccccacuccccuaaucuucccucucugcuuguggacaggaaaaagcaguuugccugaacugaacucgacccgggauaagagagcggucccuagcccaggaccaugugaacacagaauugaaaccuguggguccccaaagucacagggcugagggugguguguugucgcaggggaaagccucuggcuuucagcugucccagaggccucagcccaccccagagugagcuggggaaacagugggccagaggaucccggccucuuggcaguagagcacagagacuuucuaaggcugguggugguggucugaggguuguggcggggagggaguugaaggaccauuccugcugugagccaggagugguggaggcugggcaccccugugcagaggcugccaggccuccuugcaccgucuccuacugauccccacaggccuguggucacaggcacucagcaaucgccaucuguggccauggcuaccagcaucucacucuugcccaucuccuccaaggcacuggccaggcuguugagguccccgucauccuguugccgagcuucccagaggucuaagaugacaccugugggacuagcuuugguggcgaaguaguuuagguaccuguuggaaggaaacagaaauguuggcaccccugaggugaccagcccaugaauugggaagacccgggugaugggaagacugugggcuccagagucccgcagccuugagucuugauuccuggguuccccaguuguagacuuugcagcccuaggcaaguccauguaugcuaagacucaucccuugguccucuugaucuccuacuagcgugguuuagagguggggcugagcaagcuccugcaacuugaaccucugccuucaucaacagauaaacccauggaggaacucagagucuguaugagggcuggcaagaugguucuguggguaguguagacuugaguucaaaucccugcagccaacaugaaaaccauacgucuauaaauccacuguuccuugagcacgccauuucagggagcugggaagcacagacaggggaagucccuguaagcuccugggcuagcuuaccugacacucagggcaagcagaagaacaaagagaucggagguuauccucugaccuccacacaugcuccaugcacagcgugcugcauacacacacaugcuaaauacauguguguacaacaucugaauacacuguuggccagggcuggaccuguggacggcggggcuggucacuggggugugucuugcccuggcccuuccagucuacgucugaggugacuuuacuccaccauagccuccugacacaaugcuuuaauagacagcagcagcagcagcaagcggaaacugcagggacagacgccccugaagcuguggcucaagauccaccuugguuccuuuaaacugccggauaugauuccgcagugaggagggguugauucccacaucuccucacacagcugacaaagcccgagcucacccaaagcacccucuucucuucuccaucgccaucaccaccaccaaaagacgccgggacccugagagaccuuccaagcacgcuucugaggauuggagcagagucucuagcuaucuuuguaagcuucucccauuuauaguaacuagauggcuuuucuuuucuuuucuuuuuuuuuaagauuuauuuauuauauguaaguacacuguagcugucuucagacacuccagaagagggcaucggaucccauuauggauggucgugagccaccaugugguugaugggauuugaacucaggaccuuccuuagaacagucagugcucuuaaccgcugagccaucucuccagcucuaaaugucuuuuuaaaaauuaauuuuuagcacaugcaugugaaugugugugugugugugugugugugugcgcgugcgugcgugugucagaggacaaucucacgagucauccuuagcgauaccauccaccucacuugagacaggguuucucaucauucagcuagaguggcuggcuagcaagcuccagggagcuuccucugucuccccagugcugggauuaucagugugugucagcaugcacgacauuuucgcacgggcucuggggacugacggcacaagggaagcugagcugggagcuggccuuugucagcugggaugugcaccccacugcugugccagacccugagggugagggcaauggggaugacugcagcuugggauacucaccgguccauggacagcuucugcgccaacagccuccagucguugccccgggaguugggggcguccaggcugcugcagaucuuuuggcggauggacagggguaucuugaaggcauagggucccagcuggguggugauggcauugcccggggcagagcagagagcauccagggagccagcaggcgucuggaagggcggagaugggaaugagauaaccucagcgcuacacaggcauucacccaggcaggcagacuauggcuucccgcuccccccaagauugauugauugauugauugauugauuuuauguauaugaguauacuguagcuauacagauagucgugagucaucaugugguugcugggauuugaacucaggaccuccagaagagcagucagugcucuuaacaacugagccaucucaccagccuugaagcugcagcuuaaucgguagagugcuugcccagcacccaugaugcacugggcucuagcuuaucuucgucuccucuggcuucucccuagccccaguccagaggucaaggguugcucugucccgcgucagucaggugugaucuugcuugggaugggccuuggacauaugcugacuuagccuugggauaaggaagccgcaggagucauagccagggcccagcccacacagaccagcuuugauguaaguggggaacagucgagagcucucuagacaggugaccugccuagggcagaguaggcuugagaccugugaggagugcuuucuacuacaccggucagcuuaguuuggauuuagugguugggagccacaggucagcccuuaccuugaccagguucaaagccagccuugccugguggccauauauaauauacggauacucucucacuaaggcuuuauuuuuaaagauaaggucucacguagcccaggcugucucaaauuuacaauguagcugaggacaaucuuagauuucugauaugauccuccugccucuauaucccaagugcagggguuacagguguauagcaccacaccugauuuuauuggugguggagacaaaggcaccguacacgcuacucugccaagugagcuacagccccagcccuugagacucucaucuuucacauggggaccauuauaacccuauccccauaggcaugauaccucguaugguaauauaugucaugugaacaguacucaguaggcgacuuuuugcccacucuagguggccagguccaugcuaugacucaggaggugaaggagaggggucuguauuggagaugcuggggaguggggugcuuaugugccugagucccagcccucccccuaguuccucucccugggguaucauugagccucaccucggccaacguugugugcagcuggaaaaucuggccuuccccuucgaccugccgcacgcagaccuuacaggugaacuccguggaggccaggcuaugccucuccagggugaaagugcagugcagggcucucuggcugccauuccagacgugguagaagggaaucuccugcaggaaaggugggcaggguugcaggggggguggggcacugggagaagugaguggggcccagccuuacagagggcugggcuccagggggcagcaggagucucucugugaaacaguagggaaagcuggggcuaaauggcacugaugucucccuucugggagagaguggagaagcgggucugugugcgagggggaagacagaagucugaaugugcauaaauauagaagcuggaguauguggggccugaauggugucacacacugcaagacgaagcagagggacuuuagagccagcgaugagcagaaucagucugcacgcuugcaguuguuccgauggguguggccccagaccagcaacuugcaguauaaagggcuggaagugggguguggcagggauggcuguguguggcuguguugggggaggugcaaaaggggaugaagguguggcuguucauggauuagaauuuaagcuugggccugaagauugcugggaacacggagaaugguaaagugggaacacagggcaggguuaggagacuuggaaagcagggcuucacuacaaaggauggagcaguggucccccccucccccgcugccccuccccagacccagggcucaccugguacuuggccaguaguuugcuccuccagugggcaugggggaugucauggagggagaggcguagguugugguaacuguccuuaaagagcaaaggcuugggcuccuccaccaaguagccacccagaguccucuccagcuccaggaccuccuguagguggggcagacggaaggacuuguuacccuuggcauauggcucuuuuauauuuuuuuuuuuuaagauuuuuuauuuauuuuaugugugaguacauuguugcugucuucagacaugacaucagaucccauuacagaugguugugagccaccaugugguugcuggggauugaacucagggccucuggaagagcagucagugcucuuaaccgcugagccaucucuccagccccucuuuuauauuucaaguugcuggucuggggccagacccgucugauccagcuaagaagguguuuccgaugaauggcuggacagauacaccaauggaugaaugggaaagcuguggcuagguggauagcuagacagacagacagacugaccaauaacauggaaagcuaaaagacagauuaauagggaaguggauggauagauggauggaugggauucaugaauggauuucugguggcuggauaaaugaauugaugggauggcuaaguagauagacaauaaacuggauggaugacacaugggcggacagggggauagguagauacacagagaacauauguguggguaacaagaacuuggaaggagaauuagauagauggguuagauguauagaaggauacugacaggggucugcuggaaggauggagaacacaaagaugauggauggauggauggauggauggauggauggauagauggauguuggauggaggauggauggauggauggauggguggguggguagguggauggauggaugaauggauagauggguggauaauggaugaauggguagauggaucgauggaugaaugauaguauugugaauaugguuuauugcuuguauuauguuaacuggguucccaaaauuaaaugggaauucacacaccuacagguaggaugcugagggucccuggucccaguuggcuuugauugauauaauggcugggcagugagacagaagcaggacuuuaggauuccuggccaagaggcacaggagagagagaaaaaggcagaaccccaugcuggggaagcagaaggaucaggcgugagaaauaagacagagagacagccagcaugugagagucggggaucaaaacccaggugggcgauaggucugcaccugggaaggccaagaugggacacagguuuuagaaaguaguaauucaggaauaucagagggguaaguggguuagccgcugggaggucuggaagugcccagccauugagcuguuuaaggcauauuagauauaaggcugugugugugugugugugugugcgcgcacgugccuuccauucaagaauccagaucauuggggugaguuccucacuaucugcccgggagauuagagaggauuagccaacuacuguaacaugauggauggaugauggauggcuagaucauuggauggauguguggguaagcauaaacagauagauacacaaaugacagguauaugaauagaaggucauuugaaggaaagacauacgagcgaagagaauggcugagugaacaacuggcuguuuacugugcaaguguauuacuuauuaccacaaugagugaaaagguagagggcagauggacgggugaauagacagggcuugaacaauuaaaagaacgcaacugagccagaauguggugacuucccuguugaucuucacaccacccucuggcucagauggacagcagccaauaccagugccacaagauccuucuggaaaaaauucccagccgugaccaccccccuuuuggaggccuccuggaaugucaggguaauacagccccacagaggacgcccuucucccacagggccuuuucaucuggguugcaucaguccccagcacgcagccugagaaagucacaugagacucaagagacagagugacugggagagaccacaacucagagcuggaaagaggcacugguuugccagagagagccaugaggcuucugagagggcuggaagaaagauggagaagagagccaagucuauauccucccuuucacgcuaggaugagaccggggaccugggaaugggacagaguuggggaaggaaggggcacgggcuuugaggcauguaugacagacaggugggacgcccacuugggcuccacaucagccaguguuagcccccuuccucucugcccauccuuucccucacuuccggucuccacugccuuuucuucugugucugcuagaagcucagguuuuccuagcucaucccaucaguuccuggucuguccaucucacugaccacccacaaggcccagucucaucuccuggccauugcuacugccugcuauguggggcauacccccagcuucccaacuugccucugccucuuguucaccaauguuccuguuauacacacacacacacacacacacacacacacacaccccauagcuauagggaauucuacaaaguaccugugaacaggugucugccauagcugggccccucaccacuggucggcauccugauugcuaggcaugaccugagcuugcuaacaagcuacuaucucuccagcccccccccccacucuuacaggacuacucguacacacauccuacucugcucacgacgcugagccgcacaccugucucggcagaaggucgcucuguuggucugaaaugcccuuccucuuuucuacccagagugacaacuugucacccagggcuuaggccugaaguccgcucucucagacuucucaaagagauuccccugcuugucucccaccuccugcccaguccuaggagcugcggccuccaugccugccugaggguccauugcuguucugaggcuggugccagaaagaagccuguagggaccacgcaucuggggaggguucuaacaaccaauugauuggcugugcugaugccccugccgugcccugacaagccccuaccuucagugcuacagguguguccuccagacaguagacccugaggcuauacuccagggaggugcagagggcuggggcgaagauggccagcuggagccgcuugacugcagagcgagaguaggacucgcccaugaauacguagguacccagcugguccagcaggauguggcaggacuuagccuccagcuggcaguagcaggguguguugagggucuccucauccaaggucaccaccuccuaugggggacgaagaggacguugucaccugggcugggaucaugccguuuugagagucaccacacccggcuucucaccucccaguggcccugaugggccugggucuugagcugaaagauccagucuccagcgaugacuucagcacaguggggcacggugaggacgacagggcggcacaggaguaggccugugggcccacaggucaccgaggggcucaauacugucugggaaccuucugaaagugggcugagggggagggcagagggaggcaggagacaaaagccagaagaagucauucaucagggauacucgacucuuguggagcccccaacuccacccagggcccgugccaaggcaagucacugcccuuugcugacugggacgagaucucacaggggcaggaaggaagaaacagcauaaauggcauaaacaaaguucuagauuuuugcugucacagccaaagcuuugcacagccucaaggucugaggcuuuauagaacauugucuuuucuuuucuuucuuuaaaacaaaacagcagaacaaaacaaauugaggcuuggcuuagcggcgcacgccuuuaaucuuagcacuuggagaggcagaggcaggcagaucucugaguuggaggccagccuggucuacagagugaguuccaggacuggccagaacuaaagugagaccuccaucuugaaaaaaaacaacaauaaaaccauuuggugugugugugugugugugugugugugugugugugugugugugugugugcacaugugaauuacuuguucacgcccauguucaaacugagauggucagucuuucucugacuggaugugaggucaccgaggagaugcaccccugaugugccugucugugaggaugcucccagagagauugaaguaggagggaagauccacucuauuauguaugugaacccacauaacuuguggacugaaugaaaaagaaagagaaggugaggggagccucguacaccaguguucgucccucucugguuccugacuacggaugcuucccauuccugugaccacaggaagagggacucucaccauggcgaguccaaaugaaccccuccuccuuaaguucuuaucaugcauuugccacagcaaugggacauacacaaugcaguugcuuaccaaucccccuuugcacaggaaagguuugcuguugcuagguucuacccauuagaauaugcuuucucugggggacccugggcacugggaccaagcuucaaagggcaaauggaaacgugugugcccagugugggcugagcacgaggggugggugcuggcuggccagggcuggcgggucuacucacagggugcuuucggccuuguugauauguagauacaggucauagaacuugcccuggggaauggcuccauuugguaccaacaggcugaccccuagggaggaaggaaggcuaucagcaagaggaggaggagguagcagagaugagaaagaugggguagacucuggcuccaaccuagggaagggaaagacucuagacucggggguauggggguggauagauacagggagcacacaggcuacuuggccuggucugcccaugaauacagggggccucuaacauugcugggguaggagggucagaaugcuccagugcuagcccucaugcuggcucaggacaggacucugaaaagccaccagcugccacuuucacaagcugagaugcgcauccuggcccugcugcccuuuaaaaccaggacagcucuaugggacuaaagauaagagccauucucccaaccuaaagggaagugagaccccuuccaagugguugccccaagacuuuccuggccuacagaggcccaggaaguccugaucucaggucuucuaccagacuucucuauggguaaucugcuccaagccauaacuucacaccugagcaauggaacuggaggccuaccugugccggggaggcucagccuuccucccaggcaaccaaaggugccgcugacacugcugcuggggucccgagguaggcccaggaggugcugggaaccaaggcuggcacugcgcaggugcaggaaaugggugucccgggagaaaucgccuggguacgugcccggcgggaggacacccagcaggucggcuccaucagccaggccagacccagaaccgauggugcuggaguuauagaccuugaucuugaggcugggcaggggauccagcaggggcgaauuagucauggggaucuugucggcggaguccugcagggcauacacaggcccgcgguagaugccagcacuggccguuaggucuggaggggcggacgggugcaggagcugcggguugucugcaggggcagaugugccggucagaaccaccguucccaugccucaccacacggaccccacccacucuguucucuccaggccucugcccuacccacaauuccagcugcggaaggcucaacugcuauaggaaacuaguggccagauugggaagugccccaacucuggugacagcuacacuguucugggguccccucagccauuccugccacaccagguccuuacugggccuugcagucuugaaguugacaggguggaagccaccagugagggccgcagaggagucggugauguccgugucgaagucccggcaguuucuccgguauacgaucacucccacggccaugagaaccgcuaccaccacaaagacggccaccacaaggccugcguacagugccacaucucccgaugucuccagggcuguagaggcaguaggguuaagugagggaaaggcccuuugggguagcaaggaaaaaucuagauucuaggcuuugcccgcuaaggcagaucaguggccucaggcaagucucauaacccuugaauccaccucuuucucaguaagcugucacaaaauccccacccuaugcucacucacccuccugguacaguacagaauguaacggaaccaguaggucugauucaggagcucagucguggcucagcgcugaggagcccggggugugaggcuugggaaccagagggcgcacgauuccaccuacguggcaaagcuucgcuccaaaccuacaauucccauacaaccaaacguccuggcuccccgaaaccaucuuaaguagucucuucacuaugcauuggaugggaggugcaguggagggagggaagcacguggggugagaggcggagcaauggauggagagguggugagagggaugggaaagaaagauggaacccagggagcccacagcgaagcaauacugccuuccaccagcaggggcugcaguuguaaauaauuaugcacugccaggcagggguccacagaucauucuagaaggacagaaauauccuguucccuucauccugggaaugcucaaguagaccuaauguggcuacugacgacuaagaugugacuggugcaacuggggagcuauguuuccuaaugaauuuaguuuuaaugaagugaaauaugaauuuuaaaagccacccagggucaaugacuacuaacacaccagccaacucaggcacagcaaaguggaggccaccugacagcugcucucugaccuaacugucuuucaggagugcuaagaagcaccggggcuucauuaaaaacaggggacuugggcuggagagauggcucaguggguaagagcacugacugcucucccaaagguccugaguucaaaucccagcaaccacacaauggcucacaaucaucuguaauaggauucgaugcccucuucuagagugucugaagacagcuacaguguacuuacauauaauaaguaaauaaaucuuaacaaaacaaacaaacaaccucccccccccccaaaaaaaaccaacaggggucucuggaagagguagccuaagguccagccuggccugcacccuugggugagcccacagccacaucuuguagcauaggaggccauggcuuccugcucugggaacacugucucuaccuuaccucaacaaucucacuggggcacccccacucccccaccccacccggcacccugacaagccaggaggugcuagagacucuuccucagggcugggcucccacuucucaggaggcucgucccagcagggacaggcucaucucuaagcucagcuccacacucacacugggggccacuugcuuggugauuuacacucucugcauuagcccugggccuggccucuugcugagcugaaaccuucccugcagaaugaucuggaaauuguucuuuaauuaccacaggcuggucugaaggagaggcugugcugcccugauauugcugucacagcacuaagggcccuuggggugggaggggaguccuuugggagcugacuccgggcagcagcacucagaucaggguuaaguugggggguguggcccaguugcuagggauagauacgguguggugcacagaggugaacaggcaugucacugucucccggcauguccaccugcuuuggccacaaaaauaugugggcucaaauccugguuuuguuacuuggacagguuucuuucuccuuugagacucaguuucccauucuguaacgggagugucagggggagucggggggccuuucugacagccgagagucucacugccucucuaugacagaagcguggcagcaugcaugagguacagggagccuauagaguuuuacugggaggaaaaaacaucauuucucccugccuuggaccccacacccauggaaagccagccaaggagagccaggaauccccagaagaaagaagagaggcaugaaaugggacuuacgguggcuuuuagggucguuuagaguucucugaucugucaagggaaauaaagggaaagaugaugacucaggugacagagaaaggguggccgaggaggugaugggggcauggcauggaugagaugaagggcgagcgugggggccagacagaggcccuacagcugggccagggcagagggaccugucucccaacuccaaagcacucacucagcacgcacagcccaucagugcaguucuuggagucaaguagcgucccgcugcagucacggccuccguucugggguggcggugccaugcacucgcggcugcgccagugcgcacacucugugcugcaggcagaccacuugcuccacucgguccacgcuccauccacugcaggagcacagcacagacauggacacgcaguuacgcauucaagcggggacacggaaacaaaaacauacaugcacgcacguacgcacagacccacacacggacccaugcacgcacacgccaaucauauuugcacagcccacgggcuggggggcaguuagacacgcucaguagcugaggguaaagauacucaggcacaaagacagacauagagagacagacagacagacagacagaccugggagagaaaagucacuuggucacacauacacaaccaaagcgcaggcagaugaacccagaaccagggccacauaagucagggaggaggcugcugagaggaugagggucuguggccaaugggcaucucaacagauacaugcagggagcucucuaggacccuggcaguuccugcagccaggcucagcccuguccagcugcagcucacugccucugaucccagcucccaagcagccugggacagaaucagaaacuagaaaccauagaguacccugaggaccugggcucugcgcucuuugccacugggagaagguagugucccaacuccauacauaucccauaggcagaagagcccgggugggcugguggcuccuaccugggcacacgguggugcaagcugucuucuggaaggccugucccucacagaaggcgccuccauugaguggggcuggauuggugcagguccgaguacgcuucugccagccucggccacagcgauuggaacagggugaccacucugcccagcuggaccagccuccauucacuguagggauggcccaucaaaugauuaacauggcucuggcugccuccagguuaucuucagcccaucacccaccuuuaguaacccagccacucugguuggagccauucaucugugggacugggcacugagaggacacuguuggccccugagagggccuaggaagucacugucucaucccugccugauguacagugacgcaguaaacuugauagagggguaacaccuaaugagggucuacccagugugugaugggguucuugguagagggguaacaccuaaccagggucacccagaguguggcuggguaccugggauuuggccuccuggagguggggguggggcagaguggaggggauauauugcuucaggccccccuacaguaccgagagcucccaccagagggcacccgggauaaucacagcccaugcccacaaacacccauccacaccauagacgaugacuguggccguggugcuccggcgcuuggccacgauauucuuggccacacagguguaguuggccgugucugagaggcgcgccuggcggaugaugagguuguggucaauggugagcaggaaguuaguguccugagcggggucaaugacaucuucauucuugagccauuccaccuguggagcagggcagggaggacucauugucugccaacuguaagauggaaccugaacagcacccaucccacagggcucggaugaaugugagcaagcauaggcugcuagugucugguccucccuacgucccuaaaagcagcaggacccuggguccuguccuuagcuccgcuccacaccagcguucauaaccuaggugguuaccccaucccucucaucucuaaacgguggccgugcccacacugcagggcugcugaggagaucaaagcccagcagguggcaacugccaaucaggugcccaccuuacucacugccuaggagggcacaagcagaaaugaccaggugaccagguuuugggggcucgacagcugagacaugaaugaagcuuguccuuuuccgugccccccccccccaacgccuagaccagcguaggaugugggaggggaaagaaaggaagacggucucuagcugauggagugaauaaacgccuggacacacccauggaaauccagugguaucuacaagugugguuauuggguguaugucagguaggggugucagagaccaagacccuuccugugaggcucuaccuauggagagaugguggggucuggugugaaugggcuucagaaggacaggcaggaccacaggaagucuggagcugcugguaaauacccuaccuggcuggccacgccccccuccucaccucagccacaggcacucccuccggugggcggcacugcagaaggaccucaugauccaaggguaccuccuuggccagaggcuccuggucaaaguucuugcgcaagucugagaagaguuccaagaacaucaagggauugagcaugugagcaugaaaugcccaccguggccacuagggggcagggcaugccuauggaacuguuuacaggagcccuucaccugcggaaacagggucccccucccugacucugggaccucgccuggaauccuccagcuucccuucccagguggcaagggcugcuggaaaccccggagccugaggaggccuggccucugggucuaggagcccaugucgucuggcauacagugggaggguauuucucuuucugaucucuauggggaaguggggugggauacucaaggaggcguacaggcaaugcggauguaggcucggcgacucuugguaguucccgaagagcuccaggccacgcacuggcaccaguaguccucgagcccgaagaguuccuccacuugcugccgugacaccucgaucugcaccucucgcacccgcaagccuggccgggagagaacgggucuucagcgggaaagaaacugccucccuucuaccccagucucuggcgcgcuccagcagaaucccacuggcuuccaucugggucuaucuacggccguuccccggggcaauguaacugucuucuaggcccucagacccauucaccacccagcuagccucagcagaaagacccagguccuccacacagccuccagaccuccucaaguagccacgggccgggccacugcacacggucuccugucuggaccucuucugcgcccucaaugcccugggcgcuuccaguuaccagcagguucgcuaccugcucauccaggcaggagcugcaaguacgccuguccaucucaccgcuguccucccacgcaugggcugagggaccacugucacuauacauagcuaauggggacgacagccccagaucccagggcuagcagguacaauaugccccugauaggagcaagagccacgcuugucaccguuacuaggaaccaugggacuguuuacugccagcacaggucaucaucugaggcccacagcaggcaaacugucucuugcuuggacuagaacucauggcugguggugacugggagaaggaacucacaggccaaagaaggacuaguuguaagaaguguuuauccauaaagaauacagaaguguuuggcagggagggcccagaggguacuaguccucugccuggugggcacugugcucaugguaucuuauggccuccccacugggaccuccugcuaauagagagaaagaaggccacagggcccagagagguuguaugacugccccacagucacacagccagugugauaaggccuggaugguggguuagacuguucucuucugguuuuguuaagagaaagucuuuucuguguggccugggguugacaggccaguaucauucacacugacuguucagucgggcuugcuuuguuuugcuucgaauccuuuuaccuaucagauuuuagaugagaauggaauuuuaagacuuuuuauuucagaacccccagcaccaagcucacaccugcagcugaaccuccucaggagcacggcuuacccaguggugguuaagguuaggcgcugucugggguguggcuuuccaaucugggugggccugagaucagggcuuuucaaggcaaagcagaaauugaaggagagaaaagggggucuggaggugggggccagaagaaagcaggagagacucaaacacaaacggagaggagagcaacggaugugaccaagggagggaaacaggaaagagaagaaagagcaggugagggcagucagagccaggccggagcaaagcucccucggcuccggcugcugggcucaguacagcggacaucuguacaugccucucgcuaucccccuguucugggaaaggccuuuuacccaggacucccacacccugcuuagggugggaccuucccuaagccagagccacucgcccuugccauccccugggagagguugagagcuggcugagccuccaccuggcagcaccgugagccacaccucaggaggaagggccccgugccucuucccagccuaagauccagucacgguccuucccuccuuuagucuggacagcauucuaguacacauuguuuaaucauucaugugauauuuauaggacagggcgcccacagccugcaauccaaaauucucaccaaaucgaaucuuacuagucacuuauuaauuuauuuacuuauuuguuugucuuuugagacuggcucucugaucuugaguuuuugagacaaaguuguacucgaacucagagauccacuucccucuuccuucugcaugcugggacuaaaggugugugcuaccacuggcugaugaaaucguauuauuuaaaauauuuuuacauuuagugugugugaacucaugcacauguguaugugugugaguguguguguguucuugcgugagucacggcauaucuggaagucagaggacaguuuucuggagucaguucuacuuugugcggccagagacuaaacucagguuguaaacagguaccuuuacccugcgccaucuugccagccaacuucauauuauauuuuauuuuauaccuuguaagggacugaacccagggccuugugaguacuggcaaacacucugccaccgacccauaggcccagagacccucuucucacuuuauuuugagauagggucccaaaauaaacucaaaauaaacuugaacgcuccugccucagccuccagaguagcugagaucacaacccuacaccacaaaaccccagcccaaaaccaaaacuugauuguugacagaaugcagcagaaauugcagguuuuggggcauuuugaauguuguuucugguuuuggucguccuuccuuccuuccuuccuuccuuccuuccuuccuuccuuccuuccuuccuugagauaggagggggcuaucugauucagaauuugagcaaauucaaagucuaaaaaauucugaaaucugaaacauuccuggucccaaguguaagggccacuuaacacgaaugaaucuuucuuuuauaccaagaacagcuucuggcaaggaaacacaccaugaauguaaccagaaaaugguaccaucuuucccuaacaagaagcuauggaaagacaccagugcagguguugucuugucuggugcgcaacuucaagacuggccaacuguguggcagggugggggagccccugcuggggcuuguagcccccaccuggagaaccggaggggagccuaaggcccagggggcaccauggcucuguggcaucucugaggagcccagguggggccagccucaccuguggccucauccaggcucuccugugugacguggucauucuggcugacccacucgccauuacacuugaaguagaucugcguggcagggaaggcucugcagugcaguuccacuggcuuguucuuuacgauguaggcguccuguggcuccaauaggaaguacggcagcugcuccgcaggggcugauggguaggagucugggagcaccuggccagcagagucaacgccuguggagggagaguaccaugaacaccucauccuggggaccucauccacugccacucauacacggucuccagagccggcaauuuucccguccuggccagcccuggcauguuagugguccagaggcaagggcacccccacuagaucugcucugauuggccucagucaucucccaugucuacauacaggcugagacaaaagcacaaaccaggccagcucugccuuaaagccaucaccguccugagcaaccccacuggagacacagaggcauccaggaccuuugggguauguugugugggggugguaaugccaagcccagggcucuaagcauccugcaggcucuucucaggcucacaccuuagcagaagggagaaccuuuagagcacacagcuaggcuaaaccaguggccaccuccucccccacagggccugguggaaaagccugagucccuggaaagaacagcaccuugggaggugagacaaacaggaugggaggaaagcaggccaggccugugauuggucacaacucacuuaggaaaauuggcuuugcaucacaaaugcagaacaaucugcggcagcuugggacaagcagugggggggcuugugcuccggguucauugcugggaaaauggaaucaaaugcaggguguguguguguguguguguguguguguguguguguguacauggaccuucucaccaagcaaaugcuuguagaggcaguggggucccaggaggccuaaauagggaucaugaacuugucuguaaggucaaaaggccuuguguggcccuaaggaaguccccuguaggcagaggggcaggggacaguucccucagagcagaauagacaaaaugugucuguuuuuuucucucugugcaccaggagacucuccuaagacuggggcaaaaggcggggcagugguggugcacaccuuuaaucccagcacuugggaggcagaggcagguacauuucugaguucgaggccagccuggucuacagagugaguuccaagacagccagagcuacacagagaaacccugucucgaaaaacuaaaaaagaaaaaaaaaaaaaaaaagacuggggcaaaagauacuggauuuagagggguggggaagggggagagaguguguugugcacacacacacacacacacacacacacacacacacacacacacacaaaacacaccaaaccuagugcuuaaggagaagccagccaaugggacucgaacccauuucuuccagcaccuucuaugugaaccagagugugucuuaugggaguccugcuuuuugguugcagaggaagacuggagggaagcaccagccucugguuaggccugcuuugaagaucacaugguggucuggagugagcccaccacuggauaaguacaaauugccccaaugaagucuuaccaaaugcccacccaagcagugagcuguugaguauuugcaaacaguugaguuauuaaauucuugcaacaccccucugggugcguucuguuguccucauucauucacuuguuuguuuguccuggacucacucuguagaccaggcuggacucacagagauccgcuugccucugccucccgagugcugccagggcuacccggacugucuccucauuuuacagaagagaaauugagacucagagaggaugagcaaguugcucaagcucacacagcagagcuaaaguuugcacucaagaaacaggaccuucggccugugcccaccgccaacagagugcagcaggcaugguagccucuaccagguccucuggcaccagccaaggaugagguacuuggccugguccugcuuagaggaugcuuccuaggcccuagcuacaucugaugaucaccaucaacacagcacaacaguuucuaguuguuaguagauccaucaguuuuaaugguaucacaaggccacaaagaauuuuuuauuauuauuauuauuauuauuauuauuauuauuauuauuauuauauagucagagucaaggaauucaguaugaauuuauuccuaaaaguugagucaucacucggaaaauaccuggcauaaucacacggccacguauaccacuacucuccucacaagagcaaggacacggacauaguauaaauggcuauaaugaaaaugugguacacacacacacaguggaauaaaguuuuguagaaaaagggguggaucuggaaaugaaucaucguaagugugggaacccaggcucagagaaacugguauuucaugcuauuucucauaugugaaucuauggauuauaacuucuaauacacgcacccacauagagacacacaaguacauacacacacacacacacacacacacacacacacacacacacuuguuuuaucccauuucuacaacuuacuaacuaggauggauguugugugcaccugcugggcacagcacaaguucucagagcacaguagacgcugcccuccccacuucccguccauccccauuuauacagaguccuuaguuccuauggagugaccuggccaacuaaaagagagccagguaacauuaguguuaaaacagugagcuuccucuacuacuaaaacaacuauuccauagcacccugagguggcacagccuaguuugggaauugcaucccuaaagcaggggucccagacucuaccuuccaggagccuuucugcccagggcugugaccuggcaucaggcagagacucgcuacacucuagguaggugacaaugaccuugaacucugggccgaccugagauccaccucccagaugcugggguaauaggggugcacuaccuaagccucgcuccuggcuuucugacccuauggaaugagagcucugugggggucaucuuaaugucaucccccaccccaacuccucaccaauuuuaacucacgcgggcaaccacacacuuccaaggauccugccugggaggacccuucucgccuuggcgguuuugacagacaagacucacagaugccacuggcuggccauugcagucaggacacugaccuuggaggucacaaagcuuccuagucucugggaccagccaugucacuagucuuggaggucacacagccaccucaccucuggagaucugggcccccagauucucaaacucuuuugucuccugucucugaguccagguuugaguccaacccccgcccccccccgccccccccgcuguccuccuagagacaaggucccuguucucugggccagggacacaggcaggugugaggccaaguggacugagcaggcgcuguccgugggagcuccaaggcuccuuagccgucucaaugacuguucuggagggcagaggauguaccacacucuuccagcggaccuccguguucaugucaggagacaugauggagacaggcaguggggauggaaacacugucaguccacaggcuucuccccagagccugggcugugccagcagugaaggcgcuggcuccaaaggugccagaaccugaggcucuggaguaggcaggaggcacagaaccaagcagagagcagcuucccagaggaaucagccuaagugcacuauucucuuuccuuccuucaaaagucucucuguagaccaggcugcccucagaucugauccuccugccccagccuccugagcgcuugagucacaggcccaugucaccagccccacucuugucacuuuaugaagagagaguagcuuugccuccccugaggugaccuuugaccccaggcuggggcugagcaggagugggcagguuguccagagcucucuagccugguucaacuccucagucugaauuagaucugagaaagugguuugccucuugccugcuaacuugaggguguugccaugaggguugucacccaaggaaccggaugacagugugcccugagaguccugcauguuaccagucucagaaauggggagcaacugacaacaucacacaacacacuaacccagccggaucugaguucuguuucuggcucagggcucaagagaaaggugcuuggcuguggcggguacacacccagugucccacaucgggcuaugaacgcuuaccauuccuuucugaggccgggcuuugcucccaggguagaggucccaggacaaagcugcagcuuggcagggagggucuaggcauauccaucaccugccuuuaucccugaggccgagggauccuggcacgguucuaggaaucucucgacagcagagcaggaccauguguccagggcuggcuggcacaggacagggaggcgaggaggggguaagggaagugugcgcagaguugucccacgcugggcacauuuaucaucagcaagcacaguggcucuggacaccggcuaauucucccagcccugacucccacugcauggaaaaucucucccauucacugcgggccgcugugcucgguggggagcgggcagagauggaggagaugagccaacuuauuauuauguuuuaaaaacacaaaccccacaggcugggccccuccuuggacacagaacacugccuccaucuggcccuagauccuguggggguucaggcugugguccccccucagaggcuguuucaaugcucguuacugaugacaaauggggggcuggccagcuuggaggacaccaaguugcuccuaacaaaggaagccucucacccagcccuguucccacacccuccacagacccauccgugcccaugaugucauuugcugugauggccacaggaaguagccuugucaagagggccaaaccuaaggaggguccagaugcccacaucccuccaaggcccagacaucaggcuagaguagcccaugcuacuuacaagagugggaauggacacacaguccuugggucacugggucacugggugacccgauucacagaggcccuuggggaagcugugcugccuggccucccuccagauccuuccucugaacccugggcugccuagcauggacaccucuauagcuaacuucagugccaggcuuggugggcucagagccccgaggaaccaucuucugcguccuucucuccuggguaaggggaccaaggcuucucauccccuccucuucuagaaaaugaccuuuggucucgcauuuaaaagccuuuauagugccgggcagugguggcgcacaccuuuaaucccagcacuugggaggcagaggcagguggauuucugaguuugagaccagccuggucuacaccagggcuauacagagaaacccugucuugaaacucccucucccauccaaaaaaaaagccuuuaugguuccauauauaccagccauacaagcuugaguuacugcuccauuuuacagggcuagaaauggaggcucaaaagucaaaggacacacccaagaccauccauccacauucaugcaugauccccuggaccauugagaacagcugugucugucaucucgguggugagaaucagaccuuagccucaagcccagcauguggaccccuuccccuuagccugacccucccaaauuucagaccuguuugugggcacuuuagccaaacaauaagcuaagauuacaccccgagaaucacacgcacccuaccagaaaucacccauuaccaucucccuagacaucagaaccguuguauccuggcuaggacagaggcuccauccucggggcacuaagcuaaugccgccgccaucccucgccaacccuccgcaaggcaugccagccucccauccuuuuuuuaaucuggugacuuccaauuucagaauccaccgaacacucagcuauucccauagacgaggggaagugugcggggguggagggaagugaucuccuuguacuguggacggggugagaaguguguuccugguccucucuucuuucaccccucagccagccccgacgcugcacggauaaccgcagaugcugcggauaaccauuugaugcuucagauuacaaggcaaaccugcuccuuccuguauccucccagccugcaggcccucuuccccgaugaauuuugaagcucuuucuuugaccccuggacccacccugcuccuggccuggggcggucuugagaguccucgcugucccuccaacagcuucccuuaccccacuauagagccauccaagccaucuccaggucccuggaacuccccucccugaccucucucuuuacaguacagugcagcccuuucccagguucccggcucuugggggggggggugacgucucagcuccagugcugugagcucaggacaucccugagccaagcgucccacacccaccccucucaccuucacuauguggccuuggcguacaggcccuaaagcuagcuaggucacuauaaagcaaacuccaugaggcccuggggcugggcccacuagggaggccgacuuucucuggcugugcauccuuggaaugaggguagcaguugggguucaggagagagccugggccacaggaacguacuggaagccuggauccucagagcucaucugauaacugcccucugaaacagaaaccagagaggguguguucuggccuuagaucacaccgaaccccaucaguagagccacugggcacuagacccccagggcacagcagggacuuuauuugggcugggggcaaaguauagcacuuaccaagcaugcagaggcccgggggguucaaucccugacagcauauaaguaaguaaauuaaaaucuuacauuugcuucuaauaaacaauuuucuuggucuguucugauuauaaagauaaucauaccuuugacauuaagaugacauuaagaaugguuugggagccgggcaguggugguggcaugccuuuaauccuagcacuugggaggcagaggcaggcggauuucugaguuugaggccagccugggucuacagagugaguuccaggacagccagggcuacacagagaaacccugucuugaaaaaaaccaaaaaaaaaaaaaaaaaaaaaaaaauuaaauaaauaaaaauaauaaaauaaaauaaaaaccaacccguuccaccauggucuuugauggcuugauuuuuuucguuuuguuguuuguuuuauguuuuuaaauuuuuuauuuuuguuuuucaagacaugacgacucuauauaagaggcuggcuuugaacucacagagauccgccugcuucuaccuccauggugcugggauuaaaggugugcacugcgauaccuagccuaaauacuuuauuugagaauuucauacauagccucccucuccuccccucccuccucccccucccuccacaucagcuuccuucuacaggaagcgggcaucaacuacugauaccccacaggcguaggaaugucucaucucuaggcuucuaccauuccaugcccuucuuggucugucugucugucuagaaacuacugguacuaucuggcaccccagugggcuguccucagagaguccacuucucacagggccuugauuuucccaucuggaaaaugggaucguuuuaauuuguucugccaauuucaagaggauggguugcuuuaaauucagaggucugaaaacccuuuucucagcugggcuguucucucagcuuugucuaucugucuuguugucuuuagaagaaaggcaggugggccucauggcagcuaacagcauuuguuuuguuuuuuuuuuuuugagacagggcuauuguuacauaguccaggcuggcuuugaacuuguagcagcagucuucaugccucuggagugcugcaaucucaggcauucaaucaggcagggcuugggcuugauagacagacagcuucagguuucccggguuccagcagacuuccagccccuaccuggccuacucugugaugacacagagcuguaaaaggcugaugcaaguuggaagaagggaaugaaacagacucuguggggcagauggagcugcugccggccccgugggacacaggucccuguuccaccugccuguuugcaccugcugauguaaucacccggccgccuuggcucagggcugggccugcucaccugguuuucuaagggagcugcagguggcgggugagagggcaggagggcaggggaugacacaagugucccaggaacugcaggaaaugcacuccaggucacaggacccacugucacuucaggggagcuggccccaucucagaugcaccccauggcauaaacuggagacauaacaggcucuugguuaguuccuauccauggagcucuuggguaaaugaaggaaggaaaccuagaucuaaggaaagaaaacacuugaauggucccugaucagcuacuggcccacugggugacucuggaccagcccaauaccuuaccuaagaccucaguuuguuuaucuguagagugggugugguggcaugguacccaccucugaggcaguuggggaccagagagagaaagcaugagagggcacuaagguacucggggacagcaguaccggguggaggagcggaggaaggacgaaggcuggguucccagggagcuagagccacaggcugggcagagagccucaagagucuccccauggggaggaagcauggaagaggauugccaacuccccagagucuuggaggagccuccagaaacaugcuggggcagagaccugcugggacccccagagacguugggaacgguaggcuguuggcugcaugguaagagcugcacccuaggggaggcuaugccuccaguuaccacuguggauaccaguguucuaguuuccucagacccuuccccaccuuaggucauggcucccugcuuagcccucuaagcccccaagggaaaccagaaagucacuggacgcuaccagagaaguugguacugggaguggggagucugccccugggagaguuagggaagcagcaccguucccaggcuccacacccacauucccuggucaacaguccucggaggugggaaauggacacaggaaaguuuggggacucgccuaaguccauagaggagugucagcucccacaccugagucccuccucugcaugcuuuuuaagcuuuuuaagcucuuuggcacugaguugggcugacucagcucaaugacggugagcuccuaugacgguugguuaggugacuuuucacaaggaacccaaggaaagacacagcugcacggugccagcucuggucccuguccucccuaggaaaacacccccucuucuuguuaaacagaugucacacuguggaauguccagggaggacagaggaggcagcgcucagagcggaaccgaaccaggcaacaagaggagguuccagucuagaagcuccgcaucucugcuaccaucaucgugagcgucuaagucauacacaggaccucaaucaaucaccgcuguuuaccuaaagucacaugguuacuagauggcagagucaaagccggguguccaaccucggggcagcggaugugccaccagcaaagagcaagccuaucccuuaggcugcuuccuugcauguauuucaaaauguccuuaacuuccucccaguuuaacaccugccccucauuaagcccugggcccagggggugggggggugggggagagugucucaaagacagggacuagaggcuguggccuuggguagcccagcagauucccucucaggcuguccacucuccgguccuuuuauuggacauuucugagguucaagaguggcucauaucauccgggagagggacagccaccaacuuccucaaguccccugggauccaaaguucaaaacaauagcugugucgguggcggcggguugcccuugaugcagagguucgguggguggcuaauuuuagcugaggacuacagcuuuucccaggcacgucacuggccacugucucagcccuggcccuggacaaaaaggucucgcuuuuccuccccagcugggagcugaggacugccuggcgcucaggacaauucccuuugugccugcuuccggguggcucuuaaagcucagagaauggucagcccugagcucuccgccccagcucucuggccccucucagucucuauugcuucaagguccccuuauuguuauuccugagagcuggcauugguggggaaagaguagcaaguucggggugagggacugaugaugucuagccgcaguucagagagggugugaguggccugaggucacagagcacugaggcagagcugaccccggacuaagcaucuaucuguguacaccuaggccaaugcugugugagcagcgugcagaaacuguaccgcuuccaccugggagccugagugucaccuugacaguaccugggcaugagaggcuggcugccuucucacuccgcugccuuuaccuggugacuccuggcuccuuccucaggccuuaccuaauagaguccuccuuagagccuugcucugccugcaaccccuguaccgcccccaccaggcucccuccuguucuuccucuggcuagucuuucuuuacuaccccugccgccuccuaagcucagaugcacugguaugcuuccuuguuaauauccaggccccuccagaacccagggucccaggggacagacacucugcuauggugcauucgaaacauacugccguuaaccaugagugugggugccgagcaaucuaaagacccugggacagggccuggagaccccucuguaccaacugaagcgacaggguccugggagacugacugacugaagcucuugaagccugggacagggacaucuucacauccaucgcaagcagcauggcuucaccaugcuuucauuuugaguucaacggcaugaaggcaauaccuugucuauugcugugccucugcguuaggcugggaugcgguagauaucuuuaauuuuuuuuuuuuuuuuaaaggcagggucucaagaagcccaggcuggccuucaauucacuauguagccaaggauaaccuagagcuuugaaacauuuuuccucuuccucuugagagcuagauuaucgacauuguuguugcaccucuuccuauggggugcuggggacugaacccaggucuucaugcaggccagggcaagcaguugauagcccagauguuuuuguauauggucgaugcuuaagaaaugcuucuugcauaaaguacugaaguccccagacucuccucuggaggccucaccuucccagacaagggagccuuggggagugugcccaaguccaaguccagcccccagcccccacccccccagccagcucccagugccucccuguagaggcaggccaccucuguggccggccccugcagccucuccagccggccagcaugcuguaauuagagcgcuccuugcaggcccugguaaugagggggugucuggugccagccguaauuacagccugguuggaaggcgcaggggccgccuccaagccacauuacaaagucugcagcgggacuccugcccgcccgcucccuuuuuauggggcugguuaaagggaggcggagaagccagcucaggcugggggcugcggucuugggagaguugagcucugagaguccaggccuguaccccuuugaaauuaugcuccugccucaccccuaccccacccacgccaacauucccauccaagguagaggucagacgugcaacgacacggacagagccauccauguggcucucagcuaagcccagggucacaggccucaaacaacaaccucaagacgacauagcacaccuauuuacuaaacuaagggucacggcuuaaacaacccagucucaaucacauggugaggaagggcagaugcuaaacucuagccuagccugugacccugacugacagcagcggucccugggcaaagugcaggcagggcucaggcaagccugagagccguacaguuugcaaguugggaagcccgcuggaaucccccucuuccuuuaagagaugaagaaccugggccaggguguugcuguguggcagggugccuuguuuauaauguucaagaccagacacuggguuugaccagcaggaugagguccagagauuagaaucucagacucguguuuugucagguaugcaggauccaaggauacagagccagugcggaaagggccuugucuacuccauccugagccuuguuggccucaggaugucagucaguguggaugggaaaaaguuauuccaggggcuaaguuaguggcucucuggcacaccccccaggcaugacagacaucacuaaucgaucgcagcacaucuggacagcacaucggagcccuucuuaguacagagugcagugaagaugagauuccacaaucccugauuuaacggguccccacccucccuccauccagggugauccgaccuuaggcauacagagggcagggaagagacauggagagauguccuuagugaccaguguccaugcucagucagccugcaacuccaaccuuguggauuugaggcuuccuggguagguccuguuaaacccuagugcagaccaggggccauucugaugcauggacccaaaggcagcuuuuucaaguaagcagcguguucccuggagagccacccaacauggcagagggcaucucugcacgcagcccccaugccccucuccuccucucccagcccaacgccaggcuccaacaaccacuguccacucgccacagguagcccacgaugacggagccucuaaggugcuuccuauugcccacucugccuggaacccucagagccucucaauggugccucuaauccuggcuguugcggccaggguguggaagaguugccgcccuagagguuagugugcaaugggaccagacuggguggacacagcucugccagccccagccucuccuucacaguuuagguccugggccuccgggcacugcauggaagacaaggagucccugugacuaggggacauaacugccucaucugcuuugcugagccaggaccagagggcauuuuucaaaaggacacuuuaauuagggaacagggcagcaagccaccaggacuaugggccacacccugugcaaucagagaccuauauagucuaggcccagccucucucugaccucccucacagcacccccacgccuccucagacuguggccucuggcacagagcacuggauucuaagauguguuucccaugcagagcucuggcuucuggaggugggaacagcaucaacgaggcuuaguggagcccagaugccccucgugacagaggcaaaggcaccaaaauaucagugcuggaccaccgagcccuacuccugcauguccccaccagcagagaugaugacaaaugucccuuucagccacugccuuguuucucagagguuucagcucagaccaugagcugugcagccccagguacgguccccaacagacaacggcuuucgccucaagaacugcuugcccugcugccugucccaaaugaguggacaggacccgagcuccacccucaaccuugccccagccaccuacuuccuccucuauaaaaugggagucacccugagacucccgggccacugcuaagauuaacagagucacaguaugagaguaaccaggccagggcagggcagggcacuagagcacaaguuugccccgcagacgcugaacuaucugccuauggcacugaaacuuccaggcuccucagucuuguucacagucuuggguaaguaaacaccccagucuuauaagugcagaagcaccuuauaaacuauaaagggcuguccauuacauuagucacugucauuuuccuaauuaucuucuuuaccccauugacucaccuccguccugcccacgacagccaccuccauccuggcucagccugcagaauucuagugaaaacuggucugcaggaacccccacaggccugcaccccgaggccugagcugcuccuuagauagggcaggguccucauccuugggcagaguggcuuugaaugcuugguuugcugucaggaggaacuuuacccaucacaaggaugcucugcaggacuggggaucaaauccaagagaaacagccauguauaugugaggacccuggugacuggggguugggagggaacaugguaagagcacguugugcaaauccgcccuuggcuucuucugccuuuuccugauaggaaaccaggaagauuacccgggagaccgccaugcuguuugacuucuggugaagccuuccccacuccagaccucccuccucaaaacaggcagugcuucuaaguuccauggcuuguccugagacccaggugucaggaguagagguucuagggaaaguauuucagcugcuggagaaaaugccacgcugccuugguguguguguguguguguguguguguguguguguguguuuguguugggggucaugauuagguuuggagggacagggguagccugauccuuaagaacaagacuggguggcuggagagauggcucagugguuuaagagcacugacuccucuucugaagguccugaguucaaaucccagcaaccacauggugacuuacaaccauccguaaugugaucugacgcccucuucuggugcaucugaagacagcuacaguguacguacauauaauaaauaaauaaaucuuaaaaaaaaaaaaaaaaaaagaacaagacuaccaggcuuugaccugaucugcaagccuuccucaucucagcguggcagcaggugggcagagauaaacacaaagcccagcccacaggacagggacucggcuccaacagcugugaagguuucaugugacuuggccucucugagucuuaucccuucccuguaagucccuuagacagagagauaagaauaaauccacucacacaagguaugacuagcuggacagacacucugucuaagucucuggccuuuauuuuccuggcugcggagugggcaugccuccaugggagcaccagcaaggcuggugcacauacgcagagcaggcacgcaguguuugugggaaccacuaagaccaggagacuuggcagcauucuccucacaccuggccacggucaccucucagccuugcaacaggcacacguuguugucagcucccagguggcuguugggcccccagccagaagcaacaccuucccaacccacacacaccuccgaggagcaccuggcgugaggagggagcucgcagcccagcccugggaugccaagggagaagggacaucaaagccuaggcagguggcccugggugcugcccacuucucagcggaguccagcacaugggcacuggccaccuaggugacugguucugaggccuucaggaggaggaggaggucgagaacauagcuggaucuuagaaucugauccacggucagcauuccuucccgggagguuuagaaagcucaaccccagccuccuaccuuucccaugagguaauagcauuauuccauuuagcggguggggguggggugggcagaagcuucgcagaagugaguggcaaaacacacagagcuauggaauaucugggugggaaucaggcuucaauuucccaccucagcggaaaggcacgaggugacaucugugguacaguccuuuccuguuugccccucggugccugacagagaagccacuggaugcuccagcuaacgagggacccacucaguuguggguccaguguccucaaguauccuggguacugauccuuccugccucuccugccccccacaguccucgucacccuugacucucccugacauucccugcacagaagucuaaugucuucuuggcuuuuccucaccccaugcuggcuggacugcacuccuccaacucagcucgggacugugugacuuuggagaaguccugacccucuuccagccuugucucccaucaaggaagggucagaugagacgcuuaauagucagucuauaaucaccaaagcucacuuagacacagaggcuggguugccgcugagcaucugggaccucaagucugaguucaccucuggaauccccacugggugccugagcacgcuggucugucugaggcucaccaggcaaggccaaccuccacacaggcaccccuggucuccaucggcucucuauccgagcuuucuggacugggcucaggccuccgucugcuuccccuacacacccauccugcucuucaccugugguggcugccccuguuacugggaccauuccuggcagaguuauuucccugugugagcuuccauuaggcaggaaauacaccaguuacaggcgggacacuggaggauaagguggccauaaaucacuagacucuuuccucaccacuaccaccauggcugcuggcucugcagugccugccuuccugaaggagccguggcuagguuguaugagguucagugaggguccagcaggugcggcaggcauacaggacucaccuagucccuucugaguaagccuuuaugacccuaacaguucaacuuucuucacggugacaccuggcuauccagagggaagggccaagguugggaagagaugaagucacugagccuugaagaugauuuuuacagcaagcucacagaacaaaaaucuaagucugccuuggaggugcucggaaagaaugcgacccaggaaauguggguguucguguuaaagagcgcagccuugucccuauuuacagcuaggcuuccacaccacaccucccugcccccuuuguagcacgcaaugguuagcgcuuuuguuuuggggugcagggugccaggagugagggagagcucagcagaggcucgucaggaagggugagaaucagcccugcuagcuuagcugggcgcagcagagccucuggcuuccuccgugaacaaaguuugguugaggaaauuaaaggagaucacaggggugauauuaaaagagcaaauuacuuuaaagggcuuccgcucgguccagaucugacuguagauggauggagcuaauuagcaacgaggaguggccugcucagugaggcugaggugcuucuagggguucugcaagugagagcccccccaagcgcguccuucaccugggggaagcgcggugaugggugggggauuccgccacuucuguaccuguccucugggacuacagagaaugaaguugggaggucauucuuacccccaauccacaaagcaaccugacagggcauacaaaacaggguacggcuuuccaccugcagcuucaccucugggaagcucucacuggggacucugcuagcagugaucacagagauguucggccacagcguuccuuacuagagugaaaugccccucuggcagaguaaggaaggccugugauucgaacugcuugugcucagguaugccaguaccagcuaagaagucuucacaaugauucaaggacaguccccgggggauguuacacgaggagaucagagagauacuaaguacaugauuaaaccauaaaacaaacccgggcaugugccugagaggaaacguacuagcgggcaaggaggagucaggucugggugggauuagagugagcgagugaguguuucucagaacuuuuuugggggggugggggaagggagggaaggcggccgcgcuuaucugaacaauguaaacaaacaagcaaauaaaccuuuuccuggacucccagauacuugugagggcagcagagccuggagcuguuucaaaggacccaggaaugcugggaagugagcuuccccagugaguggcucgcugggcagccugugggagggagcucaggggcuacagcuaaccaucaggggcugcaccugcucccacaggaagaguaccucuggggacccucauuguucucuggcuaggaggaaagugaggggcgaggaacagagcccacuccgaagccaggaaauaaaucuucccuucauucaggucagcucauuuaauggggacccgggggucugaggacucgugagaaaaaucuccccaagcugggcccacgccauugaguagacuccaggggcccaucccagagguuuccuuuggcuauuuccuggcauuguugaccccauaaucccagcagcagcaggacaugcuaccuagcaucagcagacuguugggacccaggucuucccagaccuugugagaucugauaaucugugaaagaggaaacccccaccccacccccucuucuccaucagcuccacuuggacaccuuacuccccaggugcugguuaguaagaagccauucagauuugcauaaaauuuacaucaauuugcauagccaccugcuacaguggagagagcauugaaccaagacucacacuuuggagcccagucccagagauaugauuaacugacuguaugaccuugagcaaaucacuguccucucucagcaucggucucccuauucggugaacaaggggacugcauugccaggaaguguggaccuggagcagcugugcaugacagcaggaagacagacagacagacagcugggagugggucccuacuguaaucccuacuuugggcagaugcuuccugaaaacuucccgggagacaccaucgcuaacuuccuggcuucuaccaccguguccccacccaggccgggcggggauggggggagaggacacccagggaagcacccacauucacgaucuacccaguuguuccggcacuccgccccuggccagccucuggggaaaacaguaacucuggcacccuggaaauacuuucagccaggugccagggagcuugguggggccccugggaguaggaggugaggcccuggguuguccuggaaccgguuggacacagcacauacacacacauacagacagucacgcaugcacacacacacacacccacggccaccuuagcuuagaccaagacaaagaugaggaacggugacaccggucuguaccgacagaguccuugggucuguugcaaguucuucccgggcaguggaaggggaggggguggaaagaaagcuucauuccuggggagcugcucuugcggcuccuugcaucaggaucucuagggcacggugucggaggaagggcagggcaucugacucuggagaagguggccacugguacccgcucugcuguggggucaccagcauagggcagcugcugcaguuguggccagguuuggggaaaggagcaggaaagcuuuggcagcagcggcaugugagugagccaggcuuuggacugucccaaggagucugcagugaguuagaugggcaccagaagcaggagcacaggcugaguggcaaaggaacauggggcuguagcuagcugauagaguacucgccuugcacacuucaaaaguccuggauucaauccccagcauccuauaaccuaggggugggguggugguauagacccgucaucccagcacuaggggagauagagacaggcaggaagaagaaguuugagaucagcaugggauguauaagacccugacucagauguaagaacaaaaagcugagcaggagagggagggagguugcuuuauacucagaaguccuccgaggcccccuucccacccuccccccuacuccaucaugccacaccuacacacagccagaagcagguaaugaagaagaugcuagugcauaggguuuauaccacccacggucuccuuggccagggaaugaauggucccacccacaauuaagaugggucuuccucuaucaauccaugcgacccagacagucccucauucucagaggcuaaccuuacucuaacaaugcccaacagcugugccuggagaccugccuccugguguggcgcuggcaguuaaugcuacccaucauaaguagugucaucuaaguuccauguaaggguuuuaaggugaaaagguggaaguucuccacuuuacaagcagccaggggacaaccccauaggaaccucuguggagagguaacaagacguuguaauuuacuccuggaccuaugacagcuugaguauuacuguguccccaucccaaagcagacaucacuaagcaaugcuggcaaacaguuucacauauggcucuagaacucucagcucaacacaccagguaaccagcaacagaccagccucaggcuuuccaacacuagccuuuuaggucaccuuuauuuacccuugggcugaaggcacgggcugcuugaauccagggaggcugggaucaggggacaggaacuaggaugggacuccaggaaccacucagauaugggagagaaggcauggaguuuuuuugagggguggggcaaugguuaaggccucccaggaggccuagcagccaaggaaggagacacuguuugggucccgcuggaagcucagggucacuccugaagguugguggggaaaggcagggggcucugaugucugccucgcugguacugccucacuaagggcauccugaagaucaggaacugagguuccggugugguaagaggccuuuagcaagcuuggcucaaacccagcagaguuggcucugggcuuccacaccuagaguugggggggcugucugguaccaccacagacaccccagagaauaaggaaaugggcaccuguaggcgccaccaccccacuuuguaccaggcuauguuggaaguuagaaugcagcaggaccaagcucugugugcgcugggauccaugggcagauucaucccaaguccucuaucuuuguacuguggacgacccacuccacagaugacugcucugcccacucgcuaugggccuucauccuccuugguggcugggagggaggcagaaggagccacagauccugccagaggcucuucugagaacaggaaaacagcuaagaagcaacuucagggugacaguuccagaucuaagggccuugcccagagaguauggaacaagguaaacaucucagucaaacaagcucaugugaggucaucgccacccucugucggcauuguccucaagaaagucaagggcccaagcugcugcaggggaagcugggccaggacuccggaggcagccacgaaccaauaauccuaaaugugguccccuugacagcacuguuaugucagggcacgagcuuaggcugugccaaggcccaagcuggcagcaugccugagaaaccuagguggagcucacguguggugacagcccaugccaagcaagcaagcuggaccuguggccaccugccuauauucauggucuuagggucaggugcucgugcagagcuacacaaggagggaccggaugcuuggccgcagaauagcucaugugaaugaauaccucccagaggcccaguggcccucaucagaagugguacgguugggacaauaggugccgaggacaaaugugugugcucaucaccugcaggaagaccaggaguggcacacagguguaugugugcagaugguauagcuaauggggugagcauuuaugucuuucuguggagguacacauaugccagggaggacccugaaacccucgucucuguaugucuguuugcaaugaguaugagccaacauucacugugauuacagacagacucccgugcaccgaugagagccaccagcaccggcuccggcuccggcuccagcuccggucaauaugcauucaagggagccacuuuuaaaacaaagaccuugagcugcagagaaaaaaaccgcugagauccgugggaccauggagcucagcggaucuccacgggucuacugggggccguuacucgaaccucguguccauucugccuaaugcauaaauuacuaauguaaauuaaaggcuaauugaagcccuuuaggcccccaaauuuaaauuauuuagcagguagucaggaauaggagaaaagggaggaagagcugaguuuaacacccagaggggaaaaaaaaaagugccagcucagggggaagaggcaaggugccccuccuccguuccucuccccagcuuccagcugucuguucugggacuccuccuggcucugucuacaaagccuuccucccggccauguagccucccaggagaacauuccugcuuggguaagcaccgcugggccagaggcaaggcugucuccccuagggaugugguggguaggggcgugcacagacuucuucagcuccuuggaggcagggucuaggggaggccuuaggaugaccccaccccaggaguugagaagaagagccagagggggcuuaacuuagccuuggauuacuccaggggagagaagacagccagggguggcuagccauacacuaaaguuucccauccuuucccugaaagcuugguaugggccucccaggggucagcagggcacaccuagguaagaggggugauuucucugaaccagcuguguacagagguauagaagcuuccaguuuggggauaaagccauucaccgcucaugcccuaaccagaacucaagggaacaaagaugggaaaagccucugcucaaguucaugagucagcguggguguggauggggguaaaugcuagacagaguacagagagucccugcgauagcacaagaugagaggccaccugacauccaucgcaacacccguggccugccguggagcccucagugagaaggacgugagccaggacuguugacaccuuaccccuccggcucaugcacuggcugaggacucuucucauccagcuccuguggugccgagccacuccagaucauccaccauccccaaugucugggguguuuccucuuuggcacucccuccuaucaucucugugauuacacagcuuugggacagggaugucgcuuaacuacccugauugucuccuagaacuucugccaaauggccggagcucaauuacuguccgacgaccuggcaggccugaacauaccacucacugguggauggucaaggccgaugacgcucacacuugguugaugcuggaaucuaagcaaaggcccagcccagacauugcuggcgccggugcucuggugcucuuggagcagcagaggcaggaccaggcaggucccuggucagaugggggaugggcaagggaauggcaaugccuugggccagaggcaagcugcugaaugcucacugcuccccuauggggcuaacuccgucucaugccaccuuggauacugcuauggcuccacggucccgagagggagaggguggggucaaaacggugcuuguucugacaggaugaccggcacauagcuucgcuccucagcagauugcccgccacucacccagugguuccugaccgacaguguguaugucgguaggcuguuccucggugcagaagggguaccaggcucccacagcaccaucugccucucuuaggaagaaggcucuccugacgacccagcaggggagguuccagcacagauguccauccuccucugaacccaccugccccuggguuagacagccaccaagccaccuugcucgcugauacucuucuucccugaggccuucaggcuugcugggaccuguccauacccccuuauucccuucugcaggggcacagagcacccuucuauuuccaagcuccccaagucagaauacccugcucucuguuucuugcuugcuggcuuuguuuuuguagcccaggguugucuacaacuccuccugccccagucuuccgacugcugggauuacaggcgcacaucgccaggagaguccagacacuguucuuugccuaacuuuucacagaugggagccugauuaagcuaucaacuugggguggggggaacgcaucaaacuugggcccaugcuugagacacuugcuauguccacccaagccagcugcacaagucacugagagccaggggacgagccccaggcauacacaggacaucagaucauuuacagaacaacccuagaggcuauacuauuuguccuauuaguaggagacaaggccaccauccaggccacacagggacagaauacagcuccauggcaucccugcagagccaagguccucuggacugagagaauguguguguguguaugugugugugugugugugugugugugagagagagagagagagagagagagagagagagagagaguguguguguuugugagaaugaguauauguauguguguguguguguguguguguguguguguguaugugugucugugucugugucugugugucugagacuuuuuucagggaugagcagaugacuagaagagccaagaucuucuuuaccagguguuguggccaggcugauacgguacgcagccugcugucuugaucaaggcuaggaagguaucagcucuggauauauagacccaauauacccaucucaucuuucaucaucagagggagcuaagcugcuucugcuccagaccacccagaaggacaacucaaaccccccaagcuucuguguccugccuacgcccaggcugaugcugcaaggcucugccccacugggcuccugguuccauccacaaggcagagcugagcucugaacgugaagggagguaagaccgucugggagcuucuggcuugagucuggguagcacugggaauccacacugugaaaaagcuuacaggugacaaggacagagaugcucuaaggaggucccagcugaauuccagcgucccuccgcuuucccaagcaccagcuucccagagagcuagaguccuggaccgcaagcacauacacaccaugugguauaaaaagaacucuuuucaaaagcaguccccaaggguggggggaagggaggucgaugagaaaggagccagggggacaauagugaauagaguuaggauuauuuccugaacucugacuccucgugggaacgagguuaugaaaagcuuuucuuaaaaugguuauuauuuagugggcuacccaaaauaaacacacacauccaucgcacggagccaagcaggaagcgaggaacaucugggagacaucugguugcuggagaagagggaaguggugggaagcuggcccggggaggagcuggcaggagccggacgucugcaugcaguggucacccagaguuacacacacugccacgccagcacgccaagucuguggcccagcuuggaacacgaaucacacgcacggacgcaugcacacagcacauagggauagucccggcucguggcacgcgggaggaggugcacccagaagcaggcaccugugcucggcauccuucccuccucccuccucucugggaggcugcuguuaugacuuaagucuuuaccugauucccccuguuaaucuaggaaagcagcagaggaaaguacagagucuggaggggguaggagagagagcugggucugcccuguucuguucuaagcaaggggagaccuaggacaguuuucaggcuccccuggaucugguagcuccuuugguauuaacagcugacacaugagaacaugcugagguuagaccccagcauccaggaauaggauguugccauauacuugagacgccccagagugggaagccacccucuuguagcagucacagguuuaagcugcagacaggaaugucaagucacccuggucuauggagacuagaggcagccucccaacucuauacugggcacccugcaccaauccuguguggcuaaguaucugcauagcaguguggugagauacuuccuguacucgagagacucugaauaccacuaaccccacaacgaaacccagggguccagagaagagguauagcacgcaaggcagcggauguuucuagucuauugggacacagccccaaccccucugaggaaacaggauggucuagcaggggacagccccauacaagagccugaaccucagcgccaccaucuuccagcugcaaagaauugacaugagcugugucugcccacacacugcccugucucagagggcaaacgacaguggcuggacugcucucuccccucucagagaggaaaguccugcuggguaguuuugguccccagcagguguugaccaccuagagcucaaaccccuacacucucugugugggcuucccucugggcagaaccagccuauaggacucugaagugccucagcuuccucaucugcacaaaugagacugucacacucuggugacccaagguguauauagcaagcuuaagccuauuaccugcccuggaaggcaaagccccucacuacucuacugggauuaccacuacauuagcuaaguaagggccuugcgccucagcugagcagacuggacucugagugccaggcugcgugcaaguccgucaccacuaccaucgggugacuguccaucucuuuaaacggggucgcacccgcuguagcuaaagggcacaguggccuaacucgagaguuugaaaucuggccucacccugccaaguagccuagaggcaccauugugauccugugccccuggguggcacugaccauacaggacuccccccuggacugcuaacagaaaguuccccaacagcuaucagccagugauuuagaaaucuucuaggaauggguuaggcuaagaagaucugcugucuuccuggccagggaucacugcaaguucaaguccagaccauccuugcacaugaacaaagggagaagcuuuacuggcaggcacacuuccgccucugugcccucgcccuaucugauaugauaccagguuccaugacgcaaacgcuggggcucucaggcccacagggccgaccaagcugcauguaagaacauaccccauaucuaaggccuucaaagccucugcaacagggggggcuuguguaggacaccuguggggggcucauagucccuccagagacugccugggcuuaggugacccacugggcuucuuggaccugcuuggacuaacuguccuccaauggaagagcauccccgcuacucaagaccuuaguggguauagagaaauaugcaaggcccuagcugguggccugacucuccucuucccuccccuguagcuugaggacccaguuucugcuuccacauaacacaggcugagugcucagagcaggcccuggcacacaggaagccuuuugaugagcucagagacacacugagucuaaaacuaaagagucccuccacaggcagaggccugggaauagcaggaacacacaucucugcucucucccuacugcaccccccccccgcccccaccgcagucucuaagaccccaggcugagaaguagugagguccugguggguacaggagggcaugaggcugucauacucuggccuccgcucagaugcaaccauucggaggucacugcacgguauggugccacacaccuuuaaucccaguauucgggagucagaggcaagcagaucucugugaguucgaggccagccuggacuaaacagaaacaccaugucucaaaaaaaaaaaaaaaaaaaagaagucuaaaacuaaacaggccugugggaggccaaagucuacggguuacagaagcggggagaggagacuggaucuaccaggccucaccgcucacaccuuccugacccacugauucccaugccacagcuugggccuaccacaggcaggccauggcaccaaccuucauggcuggcuacugguugcccucccucugagcccugccuuucuuuauggagucuuaaggacucuuuacuagagaaaugggagacagcacuggugagggauccacauguccuugguggacaugaccaugcccauggcucaugaucccuagggcuguaagcagagcuucuaacgagaccccagagguacaggguaggggaaggaagggcagagccuuagcacucccggcucucacuugccucaagcccccuuuacugacucugcuuucaccuaagcucaaggccaguccccaguggacaggcacaguggcuuacacacauacggcuauauugagcaccaagcccagaccuacacuuuuuuaaagaaagcaucaucaucaacaucaacaucacagucaucaucuuguguaugaguguuuugccugcauaagagucugugcaccacaugcgugcuuggugcuagaggagguggugagccucgggugguugccgagaaucgaaccuaggucuuucacaacaauaacaagugcccuuaaccacugagccaacucuccagccuccgagaccuucaucacauggaaaccacaggacagaaauucagggaaaugaccccaaagaaccuaucuuccaguuacccaggagccaucugguaccagcuaccacacccacccgccacacccacucacagggaauccuggcucuugcacuggggggaugaacucgcaggcccucuugccuaugaggugaagggaccugcauuggagcccucaacugcucagacuuggugcaccggaccugccucguucaucuccuucauuaucaugcugguuccuaggcuugcaagagucucuucuggguaaccuggcucuccuaacugguggagccacugucuugugugacuuuuguaugggaaaugcuuuccccugaaacccagccgcaauccucugagccgcccgcuaccuaucagccagcauccaggaauguacuggggaagaagcuuuggugggcauucggaggaggguggucagccuucucuagguuacaaguagccgggccggagagggcauugcugaggcuaaggauggcuugcagagggccccucaaaccuggccuugcccucccuccaccggggacagcucacggaugagaggagcagggagguugcuucgcugccuccguuugcaacucuuuccugaggagguccaggcucgcccccuccaaagcaugggaagaggcauggaagagccugaauauccaggaagagagguaaagacccugccgccaggagccccgugggcaacaaggagcugaggugguaggauauucagcacugaggggagggagacagaagccagaagucuguaauccacccagaccagcucugccccgcccccaccuccacuccugaccccuggggagccccgugagagccguggcagguucugggaguuugccuagcucuccuacuaugaaacaugaguuucacaagugaccagugccuggcacgucagcucauggaaaggcuggggguucucuaacaggaagagaucucccgucgggacuucggcccacuggcuuuccuguuuccacacuccuauuuauucugauacccagauuccuaucugggggcugggguuggggggaaucaaugacgguaguuguuuaugggggaguuaaugaagcaaugccuucgcugacccuacaccugugggaagccgggagggccagguuccuugcacgggggaccucaccccaccucuucacuucuuucucccagcucagguuacagccugcucccacugccccucccccacucuagaccccgggucuggucacagcuaaaaauaaacucaaggacuggcuuaccagcacacaccuuuaagccccaggaaagaugcuuccagcuuccagauaggggucacuagucugaggaggggagucgggaggcuuccaguauaacacacugcacaccucuuagcaugggguguauaaacacaccuguggaggcaguggcccuuccacuaacuggugcuaagagugcgccaggcuccgugcuaaggaccuuuggugaauuuaccuuuugggcucaucuacccauuuuacagaccagagagcugaggaccggaucaggaaggaagagcgagucugagauccaagcuccagcaggagcaaacaagccagagggcuuucugaacuuuguggcaauguuauauggcagaccgaaugcuauggauugauucuguugugagguugaaaaugaggcucagguaggcucaguagcuuguccuaaggacuaagagaugggagaugcgacuugaagcuaaucaguuauuagagcucgugacaauaaaggggggccucuggaggucccaaggugguuucugcucacauccagggaccaauuccugcccucuuacuguuuaucccacacugggcuccugccuggccuucccucacgcacccccacuguccccgaacuuucauuauccuggagccccacccucauccaaaauccucccccccccaccucccuaaggcuucauucauaaggcucccaacucccgagcugugagcuguacaaugucagcuccaucuggucggacacuuucuuccucuccuucuuucugaggcaaggucucucugugcaguccuggaacucuguagagcaggcuagcuuugaacacaagagaucccccugcuuccgccucccaagugcugggauuaaaggcgugccaccaccggguuauagaggaacucuuuuucuuagcuuaaguaagaaaaacuccauggauguuguuugaguagguugggcacagagaaaagcauaauaaagccaggggcucacuacuguuaggaauacagagagcccguggucuuuuggacccucaaauuccagagaccccuggaccugaaucucuucauucaucuccccaaaggagacagcgagucuuccuugcacagaaggcaaaaaccuguccaaugagauguucaccaaggagugugggcugggagacccagugcgcacaaagaggccauggcuagucaaggucgggugagagaccuggcucccagaagcuccaagagguacuuuacuaagugggugcccggcugauggcuuaaggaccauuccucccugcccuagacuguaaauuuacgagcugaaaggcuggggugggggcaggggcgcucgggaggaacccaacccauaccgccagauucucagccuuagggcuccagguccaggaagccauaaagaugaucuggcugagcuuccccaccccccagcggguguuuuagaggcuggggaggggcucgaaggaaggcugggggcagggaagguagggagucagggaaagccagcauaggaaaagagugcuaggugagucggccuuuuguuugcucuccagaggcucugcccuguacuggggguucuggccugagcuguaucauggacuggcuucauaauuacaggguauccccucugaccacucugggaagcuggaagggucaggcaaaguggugucuguucccuccugcuccuaccagaagacacccuccacugacagcacaaauaugagauccacagaccaaaagaagcuugcccccaccaaaaaucacagaggucguaacugacaaugaaagccagugagacagaacugugggcucccaccucccagugaggcagggcuugugcaguccugggaaagagcagcccagaccugcuugcucgcuugccagagggcuuggugagccccccugguccacccucucugaagacugccugugaggccagaagcucuggaccuaggggaugggauucaaaggcagggagagccagaagccagagcaucaucugucuugggaguccacuccccagagucucuugcugggcuccacaugcccucugguacucccuuucaaagugucccgagcccuucucaggccagcggcucccacaggauguggaugucuggcuggcuggcugcaaucucuaccacauccccucugggcacuauccaggcccagggcugaggagugcuggaccacaggagugacuccacccucaguccccaucuuggccaauucuggcccagccucugguuuacacacccacuucucccagcgaaagcuagucaguccuacccuuaggaagccaguccuuagcuuggggcuaaaccuccuguggaguuuagcaaagacggagaagggugaggggcuggugugggggggcuggugggggauggugguggcugcuaacugguuccaccucggucuugcucagagcucucagccgggucccugguggcccccuggagaggggcugucugcagauaaucaggggacagauuuggaaaggaggaggagaaaagcacccaggcgccagacaggauccuuaucugcuggggcggaaugucagaggcagcacacuggugcgagaggccuggaggaggccgcaucugcaucugagccugggagggcagaggagacccuccuggguccuaggggacaaacauggggggggggggacuuucugggccagacagggaggaaugcaaucuacccggaaaggacuagaugccacauccuguaaccgcaacccccacccccacccccacccccaccccacccuggcucuaaauucucaccucccccaacagagacgggagagggaccgagauucccaaggacaaccagaccuagcaaucccuaaauggcagggcugucugagucacaagacuagcugggcccccuggcuagcugugcuccugcaccccagaaaccccacgcaaguucuacugcaaauucuaggacacuuaccuccccuccccaaccuagaagaaaauaccacacaaaggcaggacccagaagccccaagaaggccacggaggagcacuaggaccccuaggacacucugagcaaaaccccaggcuccaguguggaaggcacauuucuggugggcacuguuuaccugugauggauucccuggccgggccagggcucuccugggccuuucccuugggucaggaucaagggcacaggccucagguuccuguucaaacccaggaucugccacugugaacuuugaacaguagucugaagugcucacugcccaaggcuucaguacccuucgcuauaaaaugggcuuuccggcucuugucugucuuuuccacaucugacauucuaugacucuaccuaacagcuccugagaaccugaacuaccuguaaugagaaagccaggagacacagauagcucacauacaauauucacagaacaucaaauggugcccaugugcucuggggcauccugggagccagcugggggcccagauuuuaacuuccuggugaccucugccagaggcaguagcccgguucauaucacagggacagagccacagaaggaaaugccagcaagguucugaagacugaaccagagggcaucuauucugugccccacccccagccccagggaggccuggcuggccugucucucagcugucagcugcagagcuguuucccuauuagcugcucuggcugcugaaggagcaaggagcucuggacagacuacagagcugugaacaaaagccaggccaggcaguggcugcccuuggggcugaagugauggacaggggccugaggagccacaggggaggggagacaaugggaguggguggguguccaggcaaacagguuuggccaguggaagggaaacugagagugagcaggaaccuccagcauuuuccggggcuguuauucuaagcagcuuuuuauuuauucagaggucagggaugcggcuuaacaacugucagcucgauauuuauuacaggugcaucagccuggaccacggacccugugaugaggugaccacaggaccuucuuuccccccaccacccaucuccuuaguguggcuacuuggaaaccugcaaggaaaggcugaagggccuuacuuugcugaaagacagccaaagccagcucuugguuuacuuugggggaaacugaggcaccaaucuaccuccagaucauagagcauccuggucguuguaauaaacuaaugcucuggaagagaucagacuccagcagcauuuagaaaugcaguuagcaaccugccugucagcccagaggauccaggcacaagacugcaagccuugcuuccaacgugcucaaacugcuacugccucaguuuccccuucugcauaagcagggucaugccacccacuuccuaccuaggcuggaagacacccugcaacuagaauuugcuuauucacuuuuacguggccccgggauguggggaggagagacucagaguguggggggggggucucucuauagccaccaagugccuuccuuauuagguuccuaacaaaggcuucuaaggaaggcagaggcaaccaauaaaucucccucaccaagagucucuuccuaacagacugaagacguguaaaugacccagugcauugcugggagugccaacaggcggaagugguggugacaucaugcgcccauccggcuccgagccuuccagcagccugaggucagcucacagagcccuggcaccucccccagcagccccacaccgagccaagaggagccuggcacugccagcgcuggggcugggcugacagcuuggagucccuccuuccucacguccccucucugugaugcuuccccccccacacacacacacuccaacccccaccaccccaaucgcaucccugaacagcauucaccagcaaacgugagauugcugcuucucauauaacacaugagcuguggugugaacuucugguaaauggagaucuuauuuaaacugcgugcuaucaggggagaagagacagguuccaacacagcucagcucuguugccagaaaaaaggagaugccggcacugcuggagcccagagccauuggugucucucaggcaccaggagaggggcaacagggcccuggacagcacuuugccauuuauuugggagagacggacaggauaccaguuuccuaauaggguuuggcaagguuaccucacuagggaacuguuugcucugugggacaaaagaaugccguaaggucacagacaucuccagaaugacaaaauguaggugggacaggagggcccagaguauaccuaaucacagcccucugccuucuuugcagacagaacuacaaaggaacugaagucccagcacccagccuacagccacuguugcuggaaucucugugugcccacuguuggggcucaugguuggggaauacaggcuagaaucucuuggagccuugcaaagacccaaugucuaugccagacuuaaauaugcagacgggguuggggggagcaggcgugugaacucuagcaaauucuagcuaacacuucugugacacacuuagugacacacuuagcgagcaaauguucacugaggccuacucugugugggacacuguucuggccacugggccauucccaagggacacagcucugcccucauggagugagaaagccagcuaaaccagagaacuucuguguacaggcacaugagaacuccagguggugguaggugcugauggauggggcuguuaagcuuucuaagaggggacaccugagcggacacaggacaaaaagcugccagucuggucaaacugaggguuccaguguuccacaguggagcagauuuccuuauguggacgcgagggcccuucuccaugagcuauggaauccacgcuucugccaacaccccuuacauucacgaggugcccaugggaacaugccauguucaaaaugugccuagccauuugaggccaacagacauuauaacacuuucucucuucaggaaauucuacaggugacagggcuauggggacaauggaaaguguuugauggaaugaaggaagggaguggagucuauuaagcuaacccuacaccuaucagguagggaaagucucagagagaaguauacugcuuagauguggccucucugcuuugaagggggauggggacaauggccccacugcccucucaaaguugucaccaccaccaaccccuugcaccaaaccuacaccaaguuucugccacucaguuacacucauguaaauagcccauucugcccauucucgccaugguacaagccugggacacacccagggcacguccauggcuccuccaguuuguggaagauggggauggccuuuccucucacaauaccaaaacuacccagacaaaaugguaccagauaaggcuguggaguuugaagucuggugaaaucuggaaucucgccuguagggaacauagguccuagcgauccaccgcucaauuacaucaagaaagaaaauaggacagaguuggguuggaguggcugacccacauacccagggagagagaggggcagauggacgucuucagaugucccugcucaggaaaagcaggcugggucacuggucagucaguggacagacaagugaaaucaauuucuagcauggcgacuggcuuauggagagucgucccugauucuaccuuugggggaaggccuggaaaccagcuuguguggccuuagcucuucuggacacuugggaccagcggcuucccucucagcucagaguccugcucaaucugucaaaaguuugccuggcguuugaucgccagaaacucauauaaaaaagguaggcauaacggcccacauuugcagucccagcacuggggaggcagagacaggcuggcuccuaggucuaucugacuuagagcucuccuaagugaauuccacaccaguuagagacccugucuccaaaagagauggaugauucaucccugaggaaugacgccccagacuguccucuggccuccccacacaugucagcuucacacgcaggacuacauacacaagccuuggaagguguccagcaggaugcgauucucacacuggcuuauucaaguccagaggucacccucauugcucugugaugagacuguuguuuaccgucccuaagaugaacugaggacaguucuuucuauuccuaaacacaagaauucucuagaaagagccuuggaaggaaagccggggggggggggggggggggcggggcggggguuggggggagcaacgugagagagccccagcacccagggauuuugcuugguuuccuuuuccagcaguguccuggcagugggcaagcacucugguacgguaaccaaggugagaaguggggagccuuaucccacccugccaguggcccucguagaagaggcagacccucggccccgcccugccucugcaaggcuacugaccgccaagcaagauucucaggcuugcgugugcuuuuccagucauuggcuccaaugccccuggcuugccaggcccugcuccaugggcacacaaagguuguucacccucguagaugcuggcauauucccguggcuaccgcacccugguaagcaugcuuucccuggccaucuuuaaauaaccaagggcugccuugaggcugggcccaucuuuggaagggccccaucauuccuccuggcuugacccagacccagccacagggcggaaugucugcaguugaaaggacagccccaaguccuucaguucagucagcauccaucacucuacagguaacugcugagcauccgccaucuuccccuggccucugcaugcauacgcacaugcaugugcacacacacaccauacacacauuaagaaaacaaaagagaauagaaguggacacugcucacaagcacagcuguggaccgucuccuccgaccuccauaggaaugaucugauucagcccuuugugggcugacugaaagcaggccaugcucuucccacaucucagacgaggaaacagggcaaacagcaaauccaccccgccaaaggcaggcugcuggcaacacacacacacacacacacacaggcucagcaguggggugguaaggugguguccagcagagccugguaugcagucagcaggcacguuggacaucucagggaguccacacagcagaacccucaucaugcauccuucuaaucuccucugcucugacccccauccucucugugucucucuaaggcucuggacagccugccauuggcuuggccugcccauggcggaccagaagggaacagacugcucaggccagccugcccguuuucuaagaacgaguggccagcagaggcuuauguaacuuccaccgggcauagcagaugguacgccggcucacgugccagccaagccggagcugauccuaaccugcccugacauggcacccggucuccucugcuagugagcacagggcacaugccagggcaugggagcauggagagguguggaaaguggcccaaacauucgucauucaguacacauggcccagccaggccagcgggagccagggccacacagucaccagcaagcagguuccagccuuguaagaaggggauauggugucucucuugcugccucgcuuuuugggcagugcaaucccugguccacagccucugggggcucggacaacaguuucuaaaucagggaccuuucugcaaguuguggaacuguuugcuugcuuggcuuugcccaacucaguuuuugguuuguuucuuuguuucuuucccugguggguuaaacaagaguccaguagggcccguuaucccgcggggucacacagagacuuggccuuugagccaaagcuucuaagcuccuggaaagccuucuaauaauauaagcucccucacugauaaccccugggaucuaucuaugaaugacuucauggaccaacuacagcccuauccaagacgguuccaagaacccucccuagaaaggucccuuccaccuuaggucuaguggucuaguauagucugucaggcagcauuuucuaggaagaagaaaggugagcagggaguuaaggguagacucccuucaaugaagcugucucucccacuacaccuucccaaucaacaacccucaggccaaccacuggaagacaagagagacccaggcucagggaacugcaccuagauuuggagccaggauuugaaccuguguuuucugauuccaggguggacccugcuuauuugauuggaggaaggagagaaagaggcugccuaaugcuacccagcagaucugcuuuaagacugagauuagaaccaggcuaaccagguuuuuuuuuccugcuguuccucuguguguguguguguguguguguguguguguguguguguguguguguguguguguguaaggggggagugggaggacuugaggggaggggagaggagagggagaagaggagaggagggagggagggagggagggagggagggagggagggagggagggagggagggagggaagaccagaccaagucaaauuggcaagccaggaaaugcggaagccagaugaaauuugcagcaggggucaaugcguccagcagccuuggcuguuuaagcugccagacaggaguucagaucagccugugacuccuggcaagggccaguggguacccagcugugagacugguagcugagccaggcaucuugcagccucagccaagggccuggggauauuuaucuccuaggaaugcucuugauuaucagugcgggaugcaccuugggcggcugugagcagccugacccugcagccaaaucuccuaugcuccggaggccccgcucuugccaagaagcuagguaggggcaguugcuguggagggcugggccuggacucagccccuggcccugcgccucccugcaugcugcuuagucugcaccugcugcaggcugcagagccaauguccaugcaagggccacucugugcagcuccaaacagugaucagugggcuugggcaugcaaaucagauacagcuuuauuuuugagauacagucguaugcagcagcccuugguggccugggacugguuaugugcaccaaauuggccuugaacuuaggauacuccugcuucugcuuccagagcccugagguuuacaggugugugucaccaugucugaccaaacgcaaagguuuuuacagccuacuaugugucugcucugcucuccgcuacccacacaacagggaccaggaugccuagaugcaaaauuucauuaauuccuuguggcuuuguuagacuuacugaacaaauucuuucucacccaagggcuccaaccaccuagcacuuaacacuuacugugccugcuaguacuuagcacuuacugugccuuuuuguaagugcuuagugagaagagacucagacaaggcagaggggaggcggugagcggacggcugggcaucucuuacucuccaguuacucauccaggcugacaggcaccggucagagcucccuccuggccaguggcgccuguaguuucugucucacuuugcaacuaccucacaucugacacuagcaggcucccccaccacuucugaucacacagugaccaaugucaccacuaacagcccuguucccauugcuaucuccuggucauuucaacccaccccggugacaaggcaaagggacacaggugugacaguaccgcucccugugaccccaccucuggucacugcuggcucggccucuucccuucuguguuacaaaaugacuugcaggggacuuggaacaacuuuccuggcauuugugauucaacuucucauaagcucccugucucgucucgcacuaggugcugaggccccaggguuggggcagccgggcgccugauagcauuaccagucacuuugcuucagcuccaucucuugacgccaguaaugccuccgggcgccacacagggccucugggggauugccugacuagugggugaucagagcuggagaugccucugagcuaccaggcagcuccagaagcagaaaagugggccucuuuccugccaccagucgcccaguucucccaccgaggaggaugcugccaccaggggcucugucccuuguucucccacagaaucaggagagcaaggcccauuccccuaccagagcuuggcccaaaggugucguagggaaaggcaaagaggggaggcaaaggacuucagaggaccacaacuggggucagauucugacacauggcucaccagggaauuaaguacaccaagaggcuaacaaccuggcccaggaacuggaccaaauuacauccuuuaggcucccaagccaugggcucugugcucaaugcugagcagagaccucaggcuccagaagucuucugagucagacauaaaucuguagagccuuccuugugggacugugaaugucuuucucuccauccccacauaugaacagcuccuccaggcauuccccuccacugcugggccggcauaggguacucaagagccacccuucucuccuccaggaagccuuuccugacccuaggucgccaacacacacuuccugcuguuucuaauccugacguugugaccugaaucaagugcacagcugggcugggguuccugugaccagugugugcuaggaacccucaccuccguccugaaaucagcuucccuuacuccuaaaagugaacagaacggagccagagucaggcugucugucuguccuguuagaaccgcuacagcccccuuaagccuuggcggguuuccuuccuuccuucagucuccugggcccccuaguacccggggcucugucuuugaggcaagagcugcuuauggagcagggagagugaacuuuaaguccuagaagguaauuuauagccaggcaaacagagagaaagaaacagauacagagacagacacagagacccagggccccauaaugcacacaugggcaucccggucaauaaaucgacuuuccggacgggccucuauaaacgccaaugaagcgaagugguucugggucgucgguagcucugccuccugcuaacugcuaaaccccacaggccuuaaagaucuaccuucuaccucuucuagacuccaaacacagacagggagggagaguagucaacccugacccagagagggaaaggagaucgcccagagucauaaggcagaggaauaaacagugagacucaaucucaaguacaaggccugggaggggcugggccuccaagcccugagacucccugacuccucuucccuuucugagcuugccaacagugugagcggccacuacauacaugcuaggcaccccgcauaacucuuccuuacuucggguacaucagcucauaugacuucaaaacaauucuaugaggacauuacaacauguaucucacagaagaaggaaccaaggcaugggcaguuaaucgagccuguaaaugacaagggguggggaaggagggcggggagcggggaggacuauguuagccuucucagaauuccaacuggccaugucagggacccuaccuggcagcuaaggcccuagggacuggccccugcagagaagguaucagaggagauaugugaaaaugggcuuaagggugaggaaggcagcuagggaacuaacucuccccuaaugccccaacaggauuccaccgcaacuugcuaggcuccacccauuucuaggagacccagagagguagccccauguaagaauccuuuccaccccugucccagguucuacuuugagccagaggcacgggacaggacauccucaaggcuccccagaccuggaggggggagggggggcagggauuacuggugguagaggcccuggucaucacugccucuaggaagguucaggcuuuuaggauuuuucuguuguugcccaccucuguaguccuccugcagcauccaagacguuaggagccauuuugcacuuuuuggaauggacaucaggguucccucuagacaggguuagggccucugugacugauccaggcccagccugucucuucagcuuuccaggaguaguguuaucuaccucccaaacaggguucuugcaggccugagucccauacagaaaagggguuuugcaaacuaugaagugcuaugcacaaugagcuggggcgugagucuccucaaacaugacaucucaucuaagagaguagaagggagauccucagugugggcacagacgggaaggacaggguaagugucacccuacgcucccucagcggggugugcucaggugugcccgugugggcgccuauguccaagcccagccacacaucccaagccgcaagcucugcaguuccuuccccagaaaacuucagaaaccucccugagagagaugagcugcaggagccagugaggugggaggguuaguuagucuucacaucauacccccauacccgccgugggcccccaaccaugcucugggugagcugcaccugggggaggggcacaggacucuagucucagcuuccuggaucaacaggccuuguuccugggcuaccaugaguaguaaccuuucuugguccuucuagggcaaaagacuucacccucagcuuccugguccuagccuucccugggaauguauuccagccuuccuaacaacagguuccggcacucaggucagacccugcacucagcaagacaaccggagggcuucucuagccuugcagggcaaauggcagguccuguccugaagaggauuccccaacaagguacaauggauggagcuucccaggccuuucaugauucauuacacacaccuagguauacccaaacaaaaugcaccacgccuauaugacacugcacacccccacaugcucgaacagccacacacaugccacacccuuccauacaaaagguggaaaccacagcacacucugguccuccugcacacuucaccuacacacacacacacacacacacacacacacacacacacacaccacucacauaccuaagagcgaaauagcauccccccccaacccccucccggaacaccauuccaccugccacccucccacagcacuucucacaaacacuccucagcgcacaaucucacacccacagguccgccuugcuggagccggggaaguugugaugugcugggggcaccuugggggugcugagaaagagggacgucggaaaggagcggggaggagugcucagugguuaguuaggcggcaccgcugagcuccgaggacugggcagacccacaucgaucuagauuagguggggagaagggagcgaggcgggacacaaggaacaggagagcuuugauggagggugguugguacuuggugacaccaggugacugaacugaauccaaccuccaagcuccggagaugcuaaucaggcggcuuuguagagaaggggaaaaacaggagcuccuagcugcccagagcuuugggagggggaaacgacacaaaaggagggaggggagggggagagacagcugauuuaugccugcacuucaaauguuuucccugccauuagccucgggaagccuaggagccagaggaaggcgcgugggggguggggaccuguggcuuagggagcucagucuaggcuugucugcccgcgggcugcagcggaguuccguuccgauccacagccuccagauccugcgauccacauuuggcuugucaaccagcucccugggaacagccggcuucggacugccagucuucucccaaaaggcuuuaggaggggcucacuuguugcccuagcucaccaaaauggcccagguaccggggagugggagcgagagcccccuccccccggcgccgugccuguacaggauccaaaagggcaggagguggcgcuccagcccagauuucaggacccggccaauccggaggggagcaggguucucggugccuucggacgcaugaucccccccccccccaaugauucucauuaugguauucuaaauuuccuuuaaaaggggggggggaagcacagcccucacuuguuuggguucauucugccuucacagcuuuaaugacuccauuuguggaagcuguuuaggaagcugguggagaggcggaggagaaggaugccagcagaggagccagcucaggccuggcagcagccucucccuucccccuggaggccaucugccuaagcagcaguuucucugggcccguggccaccaaccuaaccucaacucacagcccaguacccagucccuggacccuucucugcagagcuuuuguuugcucuccccccugcuaccuaaaacucuacucgggaugguacuguggcuggcugggucggggugggagucgggggcuaauuaguggacacucagggucaccaaccuugccgcccaagcaccugggauggaagggauacaccucacccugcuugucccccaaaguccagggcagcccauagccacccuagacaucggggugacucagggaaaggauguuggagaacccaaaccucauacuagccccgaaccgacaagaauggggucauggugccuuuuacccaaggauuccauaagcaaaccagcagggacaguuggguccccagcucuacaaaugaaugugacccugaaaagguggccaucugacucggcaggccaugagccuagcccaccggugaccuauguuuugcuacagccaguaaguguccuuggugagcaucuaccuggucuugggggcccccaugcccaacccuugcuccggcucuguucuguugaucaggacucuugcuccccaaucaacccucucuccccauucuugcuacaaguccagugaaauccgacugccaaaaggauucuacccaacuuagguggcaccucaacuccauucagcauccugaucccagggaggcugccagccuucaggugaugacggagagaugaaggaggcugaagcauagcuaaggcaggcccucgagcccuaaguucgaauccugucucuguugagcucuacugugugaccuugggcaacuccaaacacuuuuccccaaagcuccagcaguuauaaacaggagaguugcuagguccugcggaauuccccauuguguaaggggagggggauggaccagagcagagagauuccaggagaaauuccucccgugcaguuguacuuccgaguuaaugagaaagcccauuaagacacuugacuuuccauuuguuuaagcgagaugggugcucgcuucggugcagagggagggagcagaggguuaaggcaccaaccagaaccgcacaagcggcaccagcucagacacuaggaaaacucccuuuuuaauugcaccuuuaaaagacugaucaagagcucucaacuccggcucaaccgucccagccagaggccuuggaagggcugcaagaguggggugggguagaaggaagcucucaaagccucccggugccuuugauguagccucucccggccagucacuugcuguuuggugucuuccuaagggucugcagcucuaggggucugguuuugauuuuuccaucaucaaacgugauuuuuuuuuuuuuuaaaucucaaggaguugacuaccagauucucaagagaaaggagaacuguaccuguacuuuguuugagccuccccagaaaucucucuugccucagcaacaaaccucaacacagccagguggaagggugccggaaggacaccccaccaccaccaccaccccauaguugaaguuggccuagcuaacauaaggaucccagcguccuagucagaaaucgguguuaagaagacaagauguggggaaagccugagcucuggccucgauuuuccccaucaaugaaaugggaacaggagggagucacuggaaaaacccaaagagcaauggaguagaaagaugcuucgugccuguggcauugaggaaagcaggccgugugggcaugcucuccauucagaagguagguuccuaagggaggcauauucugggcaaaggaaggcugcaggcagaccccagcagcuggcccuucuccagacuagugggcaggaggcccccgccgugcucuguaaugaacacaauuccaacaccgcuucugcucacuggugagaaaucaaagcuggguauuagagaccauuucugacugggcacuguucauacccaaauccaucaaagcccugggccugggguuucuuccgggguagacgggggcugaaugcuuuguuaagcagaaaaugcaggcccucuccagcauuccuggcccagcccacccaccuggagaacucugggcccagcaguccuauuuuucuccaaauggagccccauccccaguaacccugguaucuauuccugaccccacuacccugcugauaaauauggggaaaaauguuucccaagaugcaaccuggcccacguacuauuuccaaagacuucacucuagccuccaaucauccccagacacucuuaaacagaaacuaacaauccuggccaucccacaccuaagugcacccuuuaaaacaaggcuggucguuuagcgugccuccuccccuucuccaucauuaccuuccaacuucaaaacacugcuuuaaauacccgagucugcccaaaucauaauuaacucggaucaaaugauugaguguuguaacuuuacagcacaaagcuuggggagaaauaaaaaguggggggauguguuaaaagcaagcuccggccgugggaaacguucguuacagaggagggaccuuuagcucuugaagaaagagagguggggaggagagagagaggaugccaucaucacugagggugguggggugugugucaacucaauacuuucugcuaguuuccuuuucccauucuuagccuuugcucagggaggucuuugucuaggguggcccuccagcccccgcaccagcuucgggagucgauucacccuaacggcaguucaccugcuuggguaccagagagguuggugcgagugucuacuuuuccuuccaaggaagacgcagcccacuuugcaacgcccagccgagcuacuacagagccagcaagacacuuccaucuucgcgaugagaggagaaucggggacuuuauaaacuuaggaguccaccaaacccucuuaagagcaucuuuacuggguccaggugcagugcagaggcgagcucaccuggacacugagaauaccaauaaccuauugaaaauaggcaaagucgaaaggagauacauuacgccccuccacucucugccaacacucacccccaaacaauccaccaaccacgaaaccuuuucauacccgcccgcgccgcaccuccggagaucacgguguacaggagucggccccucccccuucaguagcuuaaagccuucgggccucggcuccccaaaggccgagaagaagcgcuuccaggguuccgcaguauccugcucucuguccgcgacccucagaaugcugcgcgugcagcccgcgggagccuguacucagaccuaaguugcaggcgaaccgcagagaacacacaccuggcccuggcagugacaguuuuuccgugauagucaggggucacuuggaagugaaucagaccccauuccacgggaagcaacuaucccuuggaggcaggagcagggagcuucgagcuuacguggcaccccagguggccacgcgucgcccccucucccgagcaccgaagcugccuuuuaacuuggacgcguccacggcguucucggagcgcagugacuccgccaagaaccacccgaacuugcaguuggacgcugagacgcgccaggaccgcaucccuguguuccacucccucucgcaccuaccugcuaggcucggugucggaucccagcaaagcagcagcgccagcagcagcgcgcuccgcaccccgcuccgggcccucaugcuccugucccccggcccgggcgccucucccucgggguucuuucccgguccccagccucgccgccuucgccuucgccgccgccucgccguucucgcaggcgcccggcagcgccagcccgugcccuccguaggcgcagaggcaaccgcgcagcgccgggaggccgcccggcgacuaggagcgcuccgggagucggacgccgcuggggaucccggcucuggugcgcccuuuccgcgcucucccgcugcgagcgccguccgcgcccugcuccgaaguugugcgaucccaguggagugcgcucagcggcgcucguagcggccgcgccgcgaagucuguccgaguggggugugugcuucccucugcgcccugccgcuccccgcggcuccgcgcccucgcccgcccugccgccggccacaau

SEQ ID NO: 12458 - RNA, 4321 nt, Mus musculus
cugagagagcagcgauugauuaauagcugggcgaggggacacacugacuguuauaauaacacuacaccagcaacuccuggcuccccaacagccggaucacaggcaggagagagucagugacggauagacuuuuuuuuuucuuuaagaagccaacaacuugguugcuaguuuuauuucuguuaauuuuuuucuuuuuuuugguguguguggauguguugugguggucuuuucuaaguguggagggcaaaaggagauaccauccuaggcucaguucaaccccucuccaaaaaaaacggcuucucuggcgcuccagguagcgagggaguugggucuccagguugugcgaggagcaaaugaugaccgccaaggccguagacaaaaucccaguaacucucagugguuuuaugcaccagcugccugacagccucuacccgguggaagaccucgccgccucgucggugaccaucuuccccaauggugaacugggaggccccuuugaccagaugaacggaguggcgggagguaagccgcgugucuucuucggagcuuguggguggggagcggugggugugggggggcuuggaggggagaauggggacuugagguggacggcgcugaccacacuggcucugaagacuggaaguaggcgcagggggagcggaaaaagauagacuagggcugccuggccgugcgcgccagcagaugcaccuggucaccaaaagccacccgcaugccuguagcuccgggcgcgcccagcuuuggcuaggcgcaggguugaagcaucaucuccugguccuugaagcagguccaucagccggacucugcgcuacugggcuagggucaaagagaugggaaaguucaucagucggguuagagcugcgcgucuggagagcucagugucaggggagcgcuuagggagcgcgcgggcagcgcucucugggcagagcccacucccggaggaucucccgagcgcguuguccuucugggguggcugggaggcaccacccaacuugcgcaucgccccaaagugaacaggguuaacaagccgaggcggcggagcagggcaaguaacagcgagaagcggcaaggagaaugccuagggaggcccgcgcuggcaccggugugcgccgguuccuuggcgaugcuguguaaagucgucuuccucagcccccgcgccuuccuagaagcgcagccucuuagucuuaggcuaagacagggaugcgcggguguccggcuuggccgaggauguugggagggaagggaacccuagacuccuuccuccgcugcccggguucacacuggcagucuucagcugaagcgcagcgggagagggagggggagguggcaccaggaauuagcuucaagaacaucacccacccacuuauccauucugggguuccccucucucgcggcuggcaccuucucuguaccgccugggauugauuggucggcucuuuuuauuggugucuguaugguugccucggcgguaagaccacaaggcaaaggagugggagagaagucagaggcagaugggaaauuguuugauauuguugcugcuauuggguguuuuuauugggaacuagagucacagauggccgggagauggaagcaggaaggggcaugcccugcuucuuggagauacaguuuuugaguuccagacucugccuaacuucuuacugucucuccaggccucaguuuccccaccuguugcucuguaguguuggaaucaugaaauggggauugccguguguguguguguguguguguguguguguguguguguguguguguguccgcgcgucagcaugcguguaugugaauuaguucuugccuguauucucauugucccaccucuucccugacuuuucccuccccagauggcaugaucaacauugacaugacuggagagaagagaccccuggaucucccguauccgaguagcuucgcucccaucucugcaccuagaaaccagaccuucacuuacaugggcaaauucuccauugacccacaguacccuggugccagcugcuauccagaagguaucaucaauauugugagugcgggcaucuugcaaggggucaccccuccagcuucaaccacagccuccuccagcgucaccuccgccucccccaacccacuggccacgggaccccuggguguguguaccaugucccagacucagccugaacuggaccaccucuacucuccgccaccaccuccuccuccuuauucgggcuguacaggagaucucuaccaggauccuucagcauucuuaucgccgccauccaccacuuccaccuccucucuggccuaccagccaccuccuuccuacccaucccccaagccagcuauggacccaggucucauuccuaugaucccagacuauccuggauuuuuuccaucuccgugccagagagauccacacggugcugcuggcccagaucgaaagccguuucccuguccucuggacucccugcgagugcccccuccacucacgccacucucuaccauccguaauuuuacucuggggggucccggugcuggagucacgggaccaggagcaaguggagguggugagggaccucggcugccuggcagugggucugcagcagugacugccaccccuuauaauccgcaccaccugccauugcggcccauccugcgaccucgaaaguacccuaacaggcccagcaaaacgccagugcacgaaaggcccuaucccugcccagcagaagguugugauaggagguucucacgcucugaugagcugaccaggcacauccgaauccacacgggccacaagcccuuccagugucggaucugcaugcgaaacuucagccgaagugaccaccuuacuacucacauccgaacccacaccggggagaagcccuuugccugugacuauuguggccgcaaguuugccaggagugacgaaaggaagcgccacaccaagauccaccuucggcagaaggaacggaagagcagugcucccucugcaccuccaucugcccagucuucagccucugguccugggggcucgcaggccgggggcagccugugcgguaacagcgccauuggaggaccacuggccuccugcaccucucgaaccaggacaccgugagaugaagcucuggcugacacaccaguuucuccaggccccagaggcccucuguccgagcugccaacacuaccacccuucccuguuccuccccaugaucccgugaucugggcaaaggaccuugauggagcccagcucugucccaccuucucacggacggccuuccgaaaacuuaggccauuugaagggaguugacugucacuccaagaaaugggggagcaaaaagagggcugggugagggccccuggccuacagggcugcgcucugacccugacugagagaugucugacuauggucugcuagcccuuuccguugacccuggaugccaguuguucugagacuuuuucuacaauagguugggaguugcugauuccuuugaucgaggacagcggaaaagacuaaauuaaagcaaaacugauguggcacuuuaauggcuugggacugacuuggggguggggguggggaguuguacagugagcagagccucauccuggcugcugcacucuggcccuagagcagugaauggagguuucucuggccaucucaacccuuaagcaauauguccuagaaacucaagagaauggaagugcaaugucgggcaggacaaagcaauauuggcuccuuuuuuuguuguaguugaggaacaaagauuauuuuuucaguguauauccauuuagauuuuguguauuuuugaugugcacugcucuccgaguucugaaccuucgggaaaaaaauguaaagcauuuaugaucucuugaaaugagucaaagguuaacuaacuuauuuaaagggggacguacauaggaugcaugcagugagugguguugcaaguguccucugugccuugugugaugugggcaguguuaacagggucugcauguguacaggaugccuuacuaugggaacagaaaaaucacuccuuggguuuaaguauggcuguauauuucugccuauuaauauuuggaauuuuuuuagaaaguauauuuuuguaugcucuguuuugugacuuaaaaguguuaccuuuguagccaaauuucaggugagaaugugcuucaaugucacugccgcugauuuguuugguuauuagcucuuaauaguuguggagagagaaacaaucuauucuaacauaaaaaaaccacuaacuggaguucagauaauggauggcuuauugacuaugguguaaauaaauacuuuucaacaaua

SEQ ID NO: 12459 - RNA, 7623 nt, Mus musculus
gacacacacauggugggguaggucuuuauuuggggggguuccagcaggcccagcccccuccaacaguaagucagagcaugcacuggccuucccuccugaccaaggacaaggccccauucccccacuccacagggcuguagugacaacacuucagaagggaaggaaaaauaaaaacauaaaccccuaaggaauggauugucugcauagaaaccucauuuaguuuaaauuagaaacaggggcugcaaguggcuugcuucuuccagguggguuuucuguaagguaaggcucugucuucacuuggguugggauagguuggguuggguagguucaaaucgggacaggaugggauacuggaguggagguagacgcuggccuggggucaggcacccugggcaccuccccucccccgccugccccaccacucagguggcguuccucuggcguacauucuuguccuugucauucaugugaguuccacugcccuuccuggggauacaaaacagggcucauuacucuuaacaggcacagggcuggccucaaccccacugaaaucuggccauuauuucaacagcagccauccaccuucccugaacuuacugaggccuaugaaagauggacacacacauugagucccagagcaucccccauuucuauaggacacacagcuagcuccccagagcccacaguggcuggacuuacaguggggcggcgccagggucauccucugcagccaggagcagccacaugaaagagaaaggacaugugucagggcucgugugaacuuggccccacacugccacccucauggugcugcagaagugucguacaucagaugaucaacacauggugaggccaacacauccuaccccagcucgccaugcaguguacagcuagaggcacccacagccccaaguccucacagcgagcuccccagaggacagcagcuuguggccaagugauggaggaaggaggagggugagcuacaagcagaccccacucuccuccagguggacacacugagggcaucccacccacucacccagacccaggacugcucaccguccagggucuggucuggcuuccgccucuucucauagauaaagaugaugguaaccaacaccaggaccucagccacgaugccuaggaagggccagagggcugccaugcggcuccgcacacgcagugagaugguuucccgaguagugcccugggcguugguggcauuacacacguaggugccagggucaacauuuacgucaagguugcugauggucagcugugacuucucaggcguggauaccaccacauacuugccauuggcuucagugcuauuggugauugccuagggagaagggcuugucaugucaugcuagagucuguccuacacugucccagauccccacaccaaagcguccucuccuguguccccucugaugcucuuauccccacucccauuccuagcacccggugccccuucugccgccuccccuacccccauguccagaaccucaugcucccacugcagccugguccuuggcaccacucaagcuccauguccuuagccucacagcccuuaccucuucuuccccagugucagaggucuuaaaccagaaccaaucuguaauaggaggguaggaugcaucggacuugcagaccaguuucgcaagcucucccucacuggaaugcucugauuucuuuccgaccuugauccuggguggcccugugaggaugagaacccugaugcccaagcacguuguagacugcucucagccccaacaccagucccuggccuucacgccagccaccuccuggcccgcccccaccacucccacagauuaccuuccacauugaucucgcuucugcccacaggcucaggaaggaagaugcaggaauauuccccagagcggucaucugcguccacucugcaggggacagagccucggugagguaaggaacucccaaggcaugguggccaccuccccaccagggcucucugugcagaucauagggccuugggcucucucacgcuauacagguaaggccacccagccaauccagagcuguguggagccuggcacugcuacacgucaggauggaggcagguccccauggacagcaucaggacaggguccuuugagcacuguggacucacauguacuucguaugcaggucgggcagaguguccuccugcaguaccuugccaccucucauccagcgguggccaacgaugucaacgccacugcuguucaaagagcagguaagcuguguuuuggaguugacuuccuggacagagguuuggauggugcccgcugaagccacagggagaaagaguauaagcucagcauaguagucagccccacucugugaggucugcuguuggaaucacagcggcugacagucuacagccccagacggcuaaagcaagcugaugcugcacuacaaaccacuucaagauaagagacgcagcugcccaagccccgccugcugcucccacagccaugugguccccucacuguuaucugaccgucacucagaacuggacacuaaacccccagagggcucugcaaagucuggcuggaauuuucagguuugcaguagacagucagagcgaacacuugggcagcagaccccaccccugccagacaaucacaggggaggcaggggaggcaggagagcaggugcauggagcagagcaggacgggaggucagggcggugcacagcagaccaaaggccuggggugcgaaccgaggagccaccuggaagagggcagggccaaccugcacccagcaaggacacugaugaguguucagcucacccgugugcccaggggagucucaaugagugguagggcagagcagcaucugguucuacaaagugggagccaggguuggguggcacgagagguaaacagaaacaggugcccuggccacucacguucaaggaccaccacgcucgccugggcacggacccacuugacccuggguggccgaguaaggugguugcggucugggucacugcuggcccggcacucguaagugccuguguccucugcggugagcccaucaacagagagcgaacuggcugcaugcugacgguaggcggcauggaugugaacacgguccagccgggcaccaucccagagcugggagcagcugucguuuggagcauucccuucaaaccaccacuggaucucggggauggggcugcccacagccucacagugcaggaccacgcugccccccgcccaccgcuccugcgacaguggugccuugaggaaaccagcuaugggaaaggguuaguacccguuacuacaaggaaggacagccaccagggccugccacaggggccaacacaacacagcaaacuccauuucuuuucugcuugcggggagaaguaugaaguuagguagacaacaaaacacaaagggcuggguaaaagugguaaccaccaagccuaaagccgcaguccaaccccaagacccaugcggcgaaguaccugugugcaacuaauguacacacacacacacacacacacacacacacacacacacacacgaaauguaauuaaaaaacgaaaacagaguaaaagccagguguuguggcucgcuuauaaucccaccacuuaggaggaggucuauacaggaggauugcuaggaguuccaggccagcugggcuauguguuuaaaguugucuccaaaaaagaaaaaaacaaaaacaaacaaauacuucaagacagggccucucaguauuacauagggaccuggaacacucagaccuguaugccugccccaaacacauguccugugggaaggcaggucuuugcaugccuacacaaggugugguugcugucuggaaguacaaguauauggguuuaggcuuaggcuuuaggcccuguagugggggugggggggugggauggcagcaggauaagcuccaggaccaagagugacaccuagagccugggaggccucaaggccccugggguaugaacgacacagcagcuuugguagagguuuccugguaaccuacauuccagagcugcgaucugugggacugcccaaccugcaguugcaggcacguggguaggcugagucaggaggaggccacagcagugagugcccuuucccuuaguccccuucccuguuuacugcuccaggaugucuguaucaacuccacuccaucuaggacugucaggaaagacggaugcccugaagaccccagccccagcuagguuucugaagagacacuauacugugggugucaucagucugggacauggcuaccauguucccaaggaccaugcgccuaauggccacauuucagcccuuuuaggaccaacuaaaugacccauaaucuagucucaggaaugcagggugcccugugguacucccuugacaucuguccaaccuucccacacggagccuagcuagcauugcuuagggguaaccacuaacuaugaucccaaccccaggagccuccacagcuuggccaugugacuuguagcccacagcuugcagcauguccccacagucccuccuuccugccuacuggcagacaggugagagcagggccagccugaggcauuggguaaacaagccagcaccacagggugcagggagggaggggggcacuguucuagagggcagcccacaggcagucuccugcuauccagugcugacccaggcuguuggcuugucaccucucucaccaugucaucuagaagccugaggaauuauuaggguuaaauuagaucuggguaagcgcugggguaacacccugcagugagugucugaguuggccuagccagggaggccagccuagucacucacucagagcaagcaugcgaaaucagggugugaagugcuuggagcagccugaagagacccuaauaucaaauucagccucauaaucaggaaaccuuaaguguccaugccacaggguagcccucugagcagagccccucccccacugcauagugggaaacacaucacugguugaccugggcccugcccaggcuguaggcuaugggucuguucccaggaaagguuaggaccugcccguaagcuacacucugugcuuggcucccgggcauugcaaaggucuguuuaaccccaggcagaaagccacugggccugugcccagccaggcuuccuacccaggacagaauaaaucaacugccuccaucucaccaggggacagcuaucugcaccaagagccagccucauggaggcaccucaagauguuuugauggugaagaagagggccuggaaaaagugggucagaauuaacgccgggcacugcugccagggacagccccuccuguaccugcugaugggggcagcagucacauggcccacuucuccaguggagcucuggcucugcccuuugccugcugucuggagagggcaggagagcaguccccauguguucgaggccuaccacauguucaaccuugccaugacccugaaucccugccuuccuaccucagcugcccuuuugagccuucaucaggcaaggaucuaaggccagaaugggccagacuccagggugggagcaagcugagugugcagagcccuggccaccagaaaucccaccaggaaugauaauccagcaagugccugagccugggguccggagccauucgcaggcacuggcucccagggaacuccuagaccagccugaagcucugccucagcccagaggggcagggacagguggccauuacagggauacagccccuguggacuauggagaaccugcaagcucaccccaaggaggacagggacagcuggggacagcugauaaggacuccuccaaaccuaggggcgggaacugccucucaggaacuccucacccaacccucacaugugagggcgaguccacucauccccagcccuccaagccuacccaucccugggcaccucuuuaccccaagaacccacggggucaccucucacccccuuuccaauccacauccuccagagaccugaggacauuacuaauaggcaaugcuaucccccaccaacuucauccucuucuuucacauuccccaagcaaugcugugcuccuucacuaaguagaaacagcaaugcagcagcuuccuccacugagaccuuccaauccuuucuccaucccccucacaucaccaaacaucaaggaccucccccaaauuccuagucaccucacuuccacccauaugcccaaacuuguggaccucuccccaggcacuucuguaccccaaacccucugaaucaucucccugccuggucccccaaguauggacacccugaaaugguagcuccuccuacucuagucccccuagugaccccaaaccuuggagacagccuuuguaggaaagucuauuucgcauccuccccuugcccagaugguaacacuaaaguaacagaccucucuaacuccaugcccuccuaaauuagggacugugacccucacucuguucccugaguggggacaccaagacugcaguuccuucgacucccaggucuuccaaauuugggaucuccccaagguggcagcuucuuuaguccccagaucucuccaauccuggaggaagccaccugcaacacugcugucccucaccccaggucccacaaaccucucucagauguccugccagaugucccucuggcccaugguuacuuuccagcccugucucucagguguggaacccucaacgugcugacuucuuuuaucuucacucucccaggccccaacaccaggaggagguaaauuacuaggguuccguuccagcccugguacgcagguggagacaccaagaugguccagacagcucccuggccacggacgcccucacucacguuggagauguugccccagagccuuacugucuuccagcgucagggucaccucuucccacaccuucccuaacuccccaaaaccuaagccaauuauagucauuguuguauccccaaaccuucagggucacgucccagcccuauuccgggagcugggacaguuagggaagcggcuccuuccaucuccagcugaccaaaaucuggggucaucccauucacuucuguaauccaaauccauccaaauuaccuuccagcccauguccugguggggaccaccacaagguggcggcuccuuccaccuccgguucccacaaccuuaggacgucucccccagaguccuaaccuuugauuugucucuccagggccucaucucuaagaucacuccccuccaccucgaugcccagucgaggcuagguucaacucgagggucacccacagccacuguuacuccuccacaaucuccaagccucgagcccgaguagggaaccaccgaguccccgaaaucggaggcucaccuuaaguccgugaccccagcccggucccagcaccccgcucuuacccgccgcgcaggcgccuuggccgcucaagagcgugaaggccagcgccagcagcagcgccgccgccaugucgccucguccaggagcugccccacugcggcucuauaagaagggcggggcgcgcgcacgcaggcacgcacguacgcacgcacgcggcgucgcagggcggggcgccaggcacacagggaguaggcacguacccagcguccgccgcucccgcucgcgcuaca

SEQ ID NO: 12460 - RNA, 2402 nt, Mus musculus
caugcaggggccacaccucucuccacugguacugcugcuagcgacuaugggggcuguguuacagccugaggcgguugaaaaccuggccaccaauaccaggggccucaucuuccuugaagaugagcucuggccccccagcagccccccugaaccuuugugccuggugacagugagaggagaggggaacacaagcagagcuucccugagggugguggggggucugaacagcuaugaguaugccuuccuggaggcuguccaggagucucgcuggggaccccaagaccuggccaccuucggagucugcagcacugacucccaggcuacccugccugcccugcagcgccuuggggccuggcuaggggagacuggagaacagcaguugcuaguccuacaucuggcugaagguacgugauggacucugucucagcgcccaugaugccuugggacugagugaguuagggcagaagcugggggagggggguuugggggagggggccucgcuggauugcuaggcagaaccuuauacacccuuucaggaacuguagugggcaagauggcaggacacaccccaaugaucacaccuuccagacagaugacagcagagcugcuguguccuuacaagcaaggucuccacaccuuggaucagggucccucaggccuacauggccccagaagaucuccagugaagaguccagcugagggaauuucuguaggacagaucuugagggacugaagcuaauggccucagagacucagucaaccaauauuugcccacagugauaugggagcccgagcucuugcugaaguuccaagagccuccaccugggggagccagccgcugggagcaggcccuguuagugcuauacccuggaccaggcccccaggucacagucacagggacuggacugcggggcacacagguaccagagacuggcaugggcccauccccuaacagccuucugguugagguugugccaaauggaaggguuggugggguuaggaguacaccugggaggcuauucccaguauggcagggguggugccuguagccugaccaucuuccccaguccugcugacaagagucccuguguccacagaaccucugcccuacucgggacacccgcuauuuggugcuaaccguggacuucccagcgggggccuggagcggcucgggccucaucuuaacccuucaaccaagcagagaagguagguccuggcagaggggaggggacagaguggaaggaagcugcccuuaaccccagcccucagccagcacgugcccacccucuacaggugccacccugagcaucgaucagcugcaagccuuucuauuuggcucugauucccgcuguuucacgcggaugacucccacccugguggugcugccacccgccgagccgucaccgcagccagcacacggccagcuggacaccaugccuuucccgcagccugggugcgcacagggauggaggaggaacugggacguuggaggggguaguugguccaccauagccucuugugcucacagcuggcccacuucguucuauuccagacugucccuggagccugaggcccugccacacagcgccgaccccuuccuagagacccucacucgcuugguucgugcucugcggggaccucugacccaggcuucgaacacgcaacuggcccuggacccuggugcgcuggccagcuucccacagggccuggucaaccugucagaccccgcagcacugggacgccugcucgacugggaggaaccccuauuacugcugcugucacccgcugcggccacggagagggaaccuaugccgcugcacggccccgcuucugcucccugggcagcgggccugcaacgcaggguggcaguggagcugcaggcggcagccucagagcugcgggaccucccgggucugccacccacagcucccccgcugcuggcgcgccugcuagcgcugugucccaacgacucccgcagcuccggggacccgcugcgcgcgcugcugcugcuaaaggcgcugcagggcuuacgugccgaguggcaugggcgggaagggcgugggagaacggggcgcagcgcggggacagggacagacgggccuugcgcgcugcgcgagcugaguguagaucugcgcgcggagcguucagugcucaucccggagaccuaccaagccaacaacugccaaggcgccugcgcguggccgcagucugaccguaauccgcgcuacgggaaccacguggugcugcugcuaaaaaugcaggcucgcggggcugcccugggccgccugcccugcugcgugcccacugccuacgcgggcaagcugcucaucagccuguccgaggagcgcaucagcgcgcaccacgugcccaacaugguagccaccgagugcggcugccgguga

SEQ ID NO: 12461 - RNA, 5789 nt, Mus musculus
ggcaggauccacguguuuauugcaggaagacaaggucuacgagagaacgguacacagaccccacaugggauggggcucccacaugcggggggcaggggugggucacagcaagcgaggccuggcgggguccccagcaccagagaugccugggcagguuggccagcagccagggugggcuccggccuccccugccacccagcccgguucuccccaggaugggcaaggccagccaggagaagccugggguggcccagagauugugcuaucagggugugucccugagaaagggcugugacccccuguccagccaggagccacucccggggcuugggagcagguggcagcugugggggcccugggcuggcuagaggucagggcucagcuaugcucagacucaggcuucaggcuguggcucucccugugccuggcacacagaagggaacacagugggguccggccuacuuggucaucuggcuucagccuucuuucugcuucucugucucuuugugaccaugucuuugucucucuuuaucuccuuuaucucugucucugucucucucucacacucucucacacucucucucucccuuccaauacacacucucucucauucuaccucccacucucccucccucucacacauacacucuaucucucucacucuucccccacacacucucccccuucacacacacacacucacucuccccccucucucucccucucucuuucucguccccaccccagagguuccagcucacucaggccacagccuggucuguagccacugugaggugaugaccucacacugaggccucuguacugcagcuuugucacuucugagccaggagccagcuugccacagccuggaacagaccuggugcucaucagacaggccugugucacccaccccugaaaacacagagccauacagacacaccacaaugucuaggugcccccccccacacacacacacggccacuuacacuguggucucacuaagaacacaaaguggugcaagaacaccccaucccaagacagacacacacccauccacacacacaggcacauaaacacagaauucuaagucacccucaucugggugggacacaggcccaggagccacucaagucuccuggacagucucgcagauaccacaggggcuccguaacucagggcagacaugggggacagucuccagaguacacaugaccagcaaagaggcucagauucugucagagcccuagggcagcagccacuaguccuaucaccgcacacagggacuuugcugauagacucucagcugggcaccccacccucagcaccccaaacccccagucgggguggcugucgaggugccacugugccaaggucucuaucucagcagaaggcugguguccaggugggcaguguccaggcagccacuccacacuccaaguucaggguuccagugugccuccccugaagggacaguccugggcuugugcugugggcgucugcuauuccagaggugguacucgggguggccagggcauugcugcaggcccuguguuuauugccuggugccugaggcccagcccucgggcccauccacccuggugugcagacaggagaggacagggguguucuggacccagggaaggccacaggucagaggucacggggaaaggacaggaucaggugaaagaaauaagauauuagugaaggaagaugaggucaaugggcacuccccagaggucacagugauagaaugugagggacagggacagugggcauggcugggcacacagggacagagauggagaggcaagguaaccucucugggccugacugggaugagcaguuccuuagccaggucccuguuuucagauccacagggaucaaaccuccagugugugguuguggggugcagauagaaugggggugggggagcaaagagauauagagggagaggucugcaaaggaugaagcuauggaggugugaagaggcagggauggagcccaaccuuacuguaggcugguggggacaggaagagggaagagagauggaggagggaggggcaaggcaaaggaaggaaggagggggagaaggagcaggagcaaagaagggaggagcagagaggaggagagaggaggagguggggaggagaggaauacuaagaggagagaggagggaagggaggagggaggggagaaggagcccgggagacucaagcuggcucuggcgggcucacaugagcgcgcacuugcccuugaugcggucagcccucuucugcuugcuggagcguuugccguccacgcugaggcugacgcuccggcgcgucucgagcgucagcagcuccuggaacagcuccuucacguuguaguucaucuucgcugagguuuccaugaaggcgcacuuccacuccugugccacggccugcgccucgcgcgugugcaccucccgcugcgucucaucacacuuguuccccaccagcaugauggggauguccuccacgcugcccuugaucugcacgaucaacuuguagauggggcucagcucauccagcgacugcuugcuggucaccgagaacaccaggauaaaggcguggcccuuggagauggacagccgcugcauggccgggaacugguggcugccggugguguccgugaucugcagugugcacacgcucuugucacagcugaucaccugccgguacguguccucuaugguagggauguaggugucacgaaacguccccuuuacaaagcggagcaccagcgagcucuugcccacgccgccugcgccgaacacgaccacacgguagucauugcucuguucuggcaucuucuccggagccggcuuggaggacagggccggcagcuagaaccccagaccgacccuguuggagaaaggacggugaaacauguaaggccuuaugagaccaggauagcucccugucccaauggccgggucacaguggugcugguccugccuccaugccacccaaguaucucccaagugguccucgcagcugcccuggcugcccuuucugacaaauauaaggccaggagugcccggagcagaggccgggcugagccugagagauggugcugaugaggccaggaugcaaagacacucaagucagcacucugggucccaccucagaccugacuuccacccagccuccagcucugcaccaguguaagcgccucacucccugcauuuugccaucuuccugccccauccuuaugugugagagagagacccugucucaaaaaaaaaaaaaaacaggguggguauugaaaagucugcucuugugacuacagcaugggcuguucucacaaagaccugauucuguucccagcacgcacauggcggcucacaaccaccagggaucuuacgcccccuucuggccuccgaaggcacugcacacauguauuguucagacucacauaaacagaagggaaaaauacauagaaaagaaucccagccgggcaugguggcgcacuccucuaaucucagcacucaggaggcagaggcagguguauuucugaguucgaggccagccuggucuacacaaagugaguuccaggacagccagaguuacacagagaaacccugucucaaaaaaaccaaaaccaaaaccaaaaaaaaaaaaaaaaaaaaaaaaaagaaucacauugugaaaaaucagauguggugguacacagccauaauccuagagccagggagccugaggcaaggggucagugaaguaugggcuacucuggguuacagagugagauucugucuaaaaaauacaaccuagggucagaggccagucuagacugaacauugagaccaugucuccaacaaaacaaaacaaaaacaaccaaccaacaaaaaaaagcaacaagaaaaacaagacgguaagcagauaucagaccugaaaacaaccaucacacaaacacagugcuucagcccuacguguccugaagacaggcuuccauccuggcccugggaaccugccacaugaaacagccuccuaacugacucugacauugaggacauccaggaaucgcacgcguaaauccugaagcagagguuccugggacucacagcccaggccaagccgagaaagccucgaagcuaagugggggcucccuguucccuaugcccaugccuuggcuuccugcucaggccacuguguucucaacagaacuccuggcugggacaggauuucucuccugucuuugcucagagaaguucauggcucucagagggucacacaguaugaggacuccuaaauuaggagagguaggggaagacuguguggaggggacacuagggaggucuguccccacuacugcugucccuuccgauucuuuuccucagcaugguucacauauggagaugguugaggacucccuggaguuagacuuagggacuaugacacugaaggggugacuauguccuugggguucaguuuucucuuuuaugggauggcacacaccuaggcuuugccugagauagagaaucaggaauaugguuagggguaagugccucagguccagccuccaaggagcccccgaaguuauggcaagcugggguuccaggguggggacgagcaucccccaugggguuugaagccauauucaaaauuaucgaaugugccuaaauaaaaggaaaacacaacaacuggagccaacacuagugacaccagaaacucucgagcuggacacuuacuugaaguguuccagcccucuacacaggguacuucuuggccuggggaagagcuggagugcuggcguggggaugcuccccagcccagcagucuuaacauuuuucuugguggguaaugggaggagaugcauggugaccccacccuacugcccagaggggaucuaagguggcaaauggagguggggcaugcaccccucaaugcaacuucuucucgguagugggcaccaggggcugcagugcccaguagggaugcccacuagauggaugcugagguuugggcccccugacaaggagggucuugugcaauccagaucucccucuuuuggggaucagggagagggcccugaacuugcagugggacaagcucugcucaaggucacgcguucuaagaggugguaugacucagagggacuuaaagcugggcccugcucagcugcugugcccagggggcucugaggugcuuggccacacugucugagucacccaagcccugggccagccugccccaaaccucucaguccacagagcagcacagggcagggcccugggacccugaagccaccucaggugcaaaaauccaggauggccuuggcgggggagagucugggggcaggggcacugacuaauggggguggcugauuuaggggcugcaggcuagggguaugaugaugaacgggcaguuuuagggacucaagggaauggggcuuccugggagucagggucucagaggagggaaggagucuugagagaggggcuuggucacgagggugcagagcucuguggggggcagugaaggaccugggccucagcgggcaguucgcacaggguauguaugaggggaccagggcccagaaggucccaagugaugcucugcguggucagguagggguggggcgaccgggagcuguccauggugaccgcuggacucccggggacaagcaaagccuggugcgguggcccgggaggguggggccggaacaaagggaucauggugguuuggggaccccuccccacccucuguggccgcggcugccccgccgccuaccugggccgcugugguccccgccgcugcgcugcuguccgc

SEQ ID NO: 12462 - RNA, 7585 nt, Mus musculus
cugaaggucauaacaaagcucaaguguuuauuaagaauuaaaaauacuguaaagaagccauacaguucauuucacaguaaacuaacaaaucuugguuuucuuuucagcuuuuucuguuuuuuuuuucuuuccuuuuuuuuggggggaggggagagggaguggaagggcaaggcagccaucaaaaacaauacaucucaaagggcaaggguacauggagaacaauuacagaaacgcagcccacgugauccucacugacagaugggggccgggcgaggcgaagggaggccucuccagagacgcugugauaaaacaaaaagaccuggcccacaucucucgggaagaugcccaaauccucuguggaaaauacagcucucacaucagaacccaaagaacacccccuccaaacgcacauggugaccccuccuagccugaugacacaggugggucaccaggaccagaagugcacugggccuucaggaccuacugaauuugcauaguuaccguuugauuggauuagggaauggagagagaccacgccucugagagugacucucaggcagguuggggguggaugugggguccucuuucgcccauucagagcugaccucuaggaguuuuuaccaguucuaaauggaagacaagaaugagacagcuucuaaaaacccuggccaggaguauaaaaaaacaaaaaacaaaaacaaaaacaacaaaccaauaaaauuaauuuuccuuaaaaaauuuuuuaaaaagugccccccaccuguccuuuguuguuuuucuauuuuacuauaaauuugacugccugacaggaucuuuuuuuagguuaaucugcuuccugauaauccccaguuaaagccacugucaucuuucuaacaggagacacauccuuuucugcacagggcuggcugggccuucaggaagccaaaccaaaagcagaaacaggacuuaagaaaccaaaggugugugguaauaacugcaaauaaauuaacugggcacagaaaaccagggcgguguccagucgguaucugcuacuuuccauggggugggggaggggcgagaaggugaugagagggcaccugggagaaaacaaugggauuuuuuuuguuuuguuuuuuuuguuuguuugguuuuggucguaagaaacugugcccacacacgcaguucacuuagaucuuuucauggaucuucucaacuuucagaaacaaccuauccaggucguuccgcaggucauccagcaagcccuuggcugacucuaaguuauucucauucguuucgauuuugacggaauaggccaccaaacuguccacggcaguccugagcauuuucaagucugacuccacuuggcucacugaggauuucagguugucuagagaggacagucuguccaggaaguccugaggaggcaagcccucggccugggcuugguccuggcugagcagugagagcacuugcuccugcagugacuccacgguaccgggcagcucacccaggcucugcuucagcuccuucaagucgcuggacagcgccagcugggucucccccaggcuccugacugugcuggccaggucagaugaggagcccagguuucccacgugcuccugcagcauagccaggcguugcucguacuccuggcucuuggacaggagcgacuccaggcuuucgguguggcgugcagaagccaccugcauugaguagaccccguccucuacauacuggagccuggcacccaggcccucaaucugccucugcaguuccucuaaggcuuuggagucuuugaagacggcaccuuccucugacccaugggccccgaccuucagcugcuguagcucuuccuccagucuccggauguccucugggagacgagaggaggacuccucggaccgcagaagcuucuccgugagggccugcagagccaggcgcucugagucggccgccugcuugaacgccuguugcuccugcuugaggcucaccaguucccgcaccucuguguagacgucggacuccaucgucugaagggaacucuucagggccucaaugucccucucccucgacaucauggaggccuggaccuccuucacggcguccuucagaguuuucacguccugacugcgaucccccuuggauucuuccagggaggccaccuucaucuugaccucauugaucuccuucuggcuccucuucuggacaucagugaagauggcgauguugucauugauagacuugguaagcuccgucaggcgcuccucgacuguguucuccagggacgugaagucccgcucccgggcauccuucaccacguggaucccguccgacagaucuuugagaaucucauucugcaacuucuguagaacuucgcuaauucgguugagcucgcucuccccuuccuucacggcuuucucugugagauccuguuuaugcugggaguuucucaggagggacucgaaagucccaaauguggcuugcagggauuggaccuacgaccaaaauccagacguuagccacugagaacaaacagcuguguucgcuuacgcuagcuaccgcuauucucugcauggcccgucccaggagccuccagaucagcgcucuccuucuaaagguaguuuuacgugguggcugugaucaccaacugcacggccccuccagguacuccagagucggcucauuacccacaucagaccagucagcauaguccauaugcgacugucaacccucuccucuuagcaaaccgacaagccaugaacagaugagugccaggcaggcugacaggguggccaacgccuuuucccacugagauugcuggcuacaggaugagggaggccuagagcugcucagaccagcacgugaccagaaacccauucaucaaucaagacagcacacggaaacaggcaagaugacauucugaagauguaacucaaucccugaauacagcuguuucugagggaguuuacucuugaacuguugggccaaucagaacagucuauacucucuuccuucccucccucccuccuucugcuauuuugggcuggcuuucuagcacuugcagcugagcaucacaaauuuucuuaggaaauagccugagacacauggagacacuaggcacaacgcuaagagauuaagucgaggucgguaucuaucacuuccaggugugcggucucuggccagccacuguccgacuucaguguccucauuuaaaaaugcgagcagugggccaggugauuucuugggacacucuggccuuugagaacacacugugauuuuguugcuacccauucauucggcauaaacgccacucucaacuagcccagcaacuccaaucacgcugggcuggcacacugacgcagaagcccugcuggucaggaaccuaggucuuaggugugacaccuguaaugucuggugacaaaauaguaauaguaauaauaauaauaauaauaauaauaauaauaauaauaauaaugaaagaagaguaagcaucccggcaguguagccuugauucuguaagucccuagguucaacuaacuauuucuggacuauguaagagacacccgcuaagacaccaugagguuguuaccagcuaaagccaguguggagcgcucugugcgauaaaugauguuuuuaacagucaacaauuaaacguauuucaaagagggaggaagacugccauucuagguuaaacuaaguuugaaaguuuuccagggguggagagaugccuacgugguuaagagaacugacugcucuuccagaagucccagguucgauucccagcaaucacauggcugugacucuaguuccuuaggaccugauguccuccuuugacuuccucagguaccaagcaugcaugcaggcauaacacccaaacacauaaaauaaaaagaaaucucugugugugugugggggggguguuccucuccauuuaaacaagagaugaaauagguugcuugccuggcauucacaagaccuagguuagagggccaagcacuuaauaaaucgggucugguggcacacuccuguaaccucagcacucaggagggagaaguagaaagaucagacguucaaaucauccuaggcuacaucugaggcuggucugggcuacauggaaugcuaucuuacaaaacaaaacaaaacaccaacaaauuaaacaauaaggcucugaagccaagcuggguaggcaaaucuuagcucaaugcuucacugcuguuugcuccuggacgcguuacauacugucuguauguaacuuguuuccuuugccacaaggugugacaaaaauaguaccugacucaccgauagucaccgugagaacugaaugagucuaaacaaguaaagugccuaacugugccuaacccucgcuggccgcuccacgcaguagcuacugucuucaccaggcuaagcucuguccugaguuccucagaggcucacggacuccuagcaacaucuuccacucaaugccaaaggagaaacagaacagggaugcacacaggauacccuggcugcagcgcaugcccaccgacugcuccaggaacucaaaaucacguucacuucccaagucccagguuggauccgacgacuccccuccccagccaaauacaaccugagucauaaaagaauacgccgagaaggcacuagagagaggugaccucuaaaacuggguuaguaaaucacaaugccuuccuguucuaagcacagcacugaaaauagaagcaugggggugagcccagagccugcaacauggcaggcuaccuucaguguuuucucaauggaccaaagaauggaggaauucagagcacugccugauaaagccugggcaggccgagcuccuauuuaaucccagguuggcacuucacaaauggcuaggaaguuaaucagaucagaaacuauuaccagucccccaaggaacccagugucuccccuucugaggucauggggugugugugugugugcuucuuuaugcacaaagugcucauaacaguuaaaauguacuggauggaugucuguccuuuugacaugugggggaugucugcuguguggugcgugaaugccagcgacggaauaauggcugcaacuccaucccugccuuuguggagccuucugggguaacaguggacaggccggugcuacuacuaauggcugacagucaacggggcugucgcaggcauacagaggccagacacugacugcucucccuguucacuuguuuguguguuuguuuguuucuuugacacaaggucucuuacuggagcuggaguaccccgauuuggcuggacaggccggcuggcaaacuccagagauaccuccugucugugccuccccaacaaugggauuccaaguguggacuuuuacacaggcccgagaaaucugaacccauguucuuaugcuuucacaguaagcacuuuaccagcugggcuauccccaaucccaguucuuacaaaccuugauggcgccuuccucuugccuggagaaugagaaacaggcucaaagaggaaagcgauuugcauacagcugugaaugggaagggguaaaaccaacaaagagaccaaaaggcaacauaggaacuaacacccauguucuucaaccuggaucuaaccacuuugggcucaagcuuccaacuuccccuguauucugucacuggaaggcuagcuaccuucuguccuucagguauagucgagauuguccccuuaccuguauggggucaugccaucuccugauacuucuaaugaccagcccugucccacauacaaacccacaagcccuuucuucucaaagugugcauaaguuccccaccccugaaaccuacuuaggaugccacuucacaagcuugaucugcgccuuuuccuccuccauauccuccacagggcucacgcacagccauacaacuaucaggcuucaauaaauauuaugacugauuaggaagagaggaaacgggcuagcgaucagacucccgcggggugucuguguucuuaggauggucugacauucagcaggcagagcagaaucgcccacuucauuuccccagcuaagucaccucccuuggccuacaccacuucacaggcugacucacuccaguugcucuuccagucuugagaggaaauuccuaguggugcacacucaacaaaaaaguagggacuuggcagggcaagcggcaugcugggaaaggaggccgugguuccgggcucagaaauggcgggauuuuuuguuuccguccagcaagugcguuucauugagcaaggauguggguggagaggauggagaaggcacuagagggaagggggcuacacuugggcuggaaggguagaaacugagcaguuugccaugagaguugucuggucauuccugaaacagcucgcuggggaauccuuccucacgaauggcccacacuuucuuccacaaucugcgacucaagccagcuguggucugugucaacucacuuugugucucuuaaaccucaauauucgggucuggaaaauggagucaaauuugucagcccucucuuccucccucuaguuaacucuuugagugaggaaauaaaauacaugaauacgcugucuacacaccacauaagugugaucuaauacuucuggccuguguuuccccuaaagcuggaguaggcgacuucaaaggcccacaugggcuccuugguccagcuaaggacaagggaccuaaagauagacguuucaucugaacuuagcaaaugacuaagcucacuagcuucccccacccccacccccaaaacucuaggucuauuaaaaacuggcucgggugacuccuacuggcauagccaaggugaagucuugacuagaggcuuccggggaugcgaugauuucccuuccaggcuccuguucgggcaacucuguccauucaacgguuccuaaugcaaaaagaaugggcuacguagagccugccggcuuccuuacaggucaccgcuaauguccugugacaggcccuuggcccauccucccccaauggucuggccauccucagaguccgcuccaucccucucugagaccauuaacaaagcgggucugggaccgcccuggcgacuagggcgcuggggucccagcucuugccacagggccugggcaggaaaggaccagggccccuucagggagggcaggaguagagucccgaccccgcaaaagcuggaguacccaccuucugcucgacgcccugcaagcccuggcccagcucaucccucugacgggagaaguccugguggccacgccggaccugcuggaccuccuccaggacgugauggacauaccagcccgagaaggcggccgccgccaccagggagagguagaagagaaaguugagcacccggccaagccugcgcgagcaggacgcggaggacgcguuggcgguggcggcugaggaccggccgcgguggccgccccggugcgccugguucugcgggugcugcggcgggugcggcgcgggaggcugcggcugcugcggcgccgccggcggcuucuucgccacgucauccgcgccgcccgacgggugggcgcccuuguccgaggggcucgcggcgccguggccgcccuuggagccccuuuguuuggccgagggcauggcggcggcggcggcucggcgg

SEQ ID NO: 12463 - RNA, 4847 nt, Mus musculus
gguugcaaagguauacuuuauucauaugcaauuagacagugauaaacuauaaaugagcgaguuauuugucauucggguguagucacaguuuucagcuguauagggaagcaccaggugucaagucucuugagacacugcuuucuuucagggacagccuguuacuaccugacacauucgagugcugucuggccugcuguuaaagcgcuggcccggaguguagacaucuccucccaucagcagcaccucccggggucacugcagcucugaauguuucuuauuggucagugaaguaaagguacaagcuacaaucugaguucagucagccgcuuggcugucccccacccccagauacaaccccgcaaucacagucuuggcuaauuagucagaaagaauaauuaauuggucaaagagaaauaguugaggagacagaaauuauaaauaacacauauauuaauaggaauucacucuuaucacauauaaguuguuacuauaaauacuucuuugguugaugcaucuaaaauagauucuccauauaaauaguuuuaaauauuaauaaauagguuuagauuuaaaaauucaaauagugcuggcagaauuauucuuauugggacaaucucuuccccaccccgaaucagcagcgacuccuuuuccgcuuccugaggcuggauuccggcaacagcugguggaccacucggaugagcucauugaaugcuuggcgcuggaccuguggguuguugaccuaauggggaaaaaaaugaaauuaauuccaaguauacaaguuguugggcuauuuuuguuuuuacaucauggucagugaagauggaaaucuuccuuuuaagaaaaguacagcaauauauuccuucuacuugugguauucacuucuguagcaguuaagaccaucaugauuucuaaguuguaccacagggagugugcugagccaccucacacaucacacaucuaccuuucccuuaacugcuacagaaaacucaaaauggagaauuaaagagacugcuggguggcaugggguggagaaagaauggggaugaauagacgguaacucugaacuugaaucagacacuuaaccugcaggaaccuguuuucuuaugaagauauuggcaagauaaucucuuaucuacaaggucuaccaccuucuucuuugauuaguccucucuauucagaccaggaaaaacauuuauguuagccaaggcuccccuugcucuagcagaaugcuuuggauaucuaccaaggagcccagagacccagaugccuuugugagcuaagucccaccaagagauucuguacaagccacaauuugagagccaccaacagucuaaguacuguaggaacaacccaaguccaaaauaaaugaaaaaauauauauuuucaauuuucucccaaaucagauaggugucaucauuucugggaugggauuaaaaauaaacacaaaucaugaccagauuaguaauaaucaauuuguugacacagagaguaguuacaauuugaaggugcaacaauauuuccucuucucugcuuucuccaucauuaauuuaacuacuuagauuuuuucauucuaaccagaaggaccacuugggcaauuuugugcuuaguaaaaugaagaccauuuacugcuguguggucugucugucugucugucuguuuguuuguuuguuucuaauacugaaaauacucugacucccuugcuacauuuccaagaaagacacagaaguuuauaggacuaguuacuaaggaaaguguauguguguguguguguguguguguguguguguguguguguguguuccuaaaacauguugacaaugcaucaauauaggauaagaguuaagagcuugucacaaggucacccacaggaagcacaagacccaggguuuccaaaaagaugaaaccaaggccuggggaguuacagguuucucccaacuguguguugugaacacaaauguauuuccuguguuucaggacauugucaagacuccaagagacuuagccagagcaggauggaaaggcagaagcaaagucagugagaaacgauuauuucauccaucucuaguccauggacuaagacgggcuaccaucucccugcuccugagcgagagcgggaggcuaguuagaggcagaggcagguagccugaaaggugagcaugaguaauuaggccacaaaauguaacaagacaccugucccuuucauuugacgucauucaucaucaaagcccaaggauguuuggaaugccuuuggccuucuauguaaaauuuagaagaaugagaauagucuuuaugcuuuuaaguuaccuuuuggauucucacggccauacuuuaaagguacuuuuaagguaguuucaugauauaaagcaugaauggcuggaauaccgccauaucugaaaguuaauugaccaagccuuucauaagauguauaaagcaauccuuuuaaaggaugucuaccauugcuucgccugaaaacaaacuggacugcauagcacuagaggcuaaccagagccgagggguaggacgcccagaagucuccucagagccugauuccuuuccuucccucauccucgucuucuacccuugacacuguggagguuucauuuuguuuuguuuuugacaaaagagauaaaacuuauguagcgaucccaguugcaccccagccagucgugugagucaucuguagucagcguuccuccuuguggccuaacuaggaggaggaggaggaggaggauacaagucuucucacucccuccuacccacugcucuuuccacuaacacacaaccucccagccuaagcaagaguuuccaucacacacccaggggggaccacaagagcucugcucaaugcuccccuauucugccuccuccucagugcauuuacccagcaugugggcaauaguuugauugucuguguuuuuccaaaauugacacacacacaaaaaaaaguccucccaaucugucugcaguggggaaacaugagauccugcuucaccuccuagcuuuaucagcugaugaguaguuaguuucuaccgcuugauaauuagagacaaugaaaaauaaaaagccaacaauacagcaacuugcaaugccgucucaccucaaacuuggcaauacucaugaaugcauccuuuuucgccuugcuguugcugaagaagguaguaaucaggugugauucaaugacgcuuauguuguugcugauggccugauugucuuucaagacuucaaagagucugagguagaaagagauaaucuggcucugcaggauuuucaugucaccauccuugggaaauaacacaaagggaggauuuuaagaaaugacccauuagaaacaacagggaaacugggagaggagaaauauucaacucaccuuuugccaguuccuccagauauccaagaagagacucuuuucuuccacaucuaugccacuugaguucugaggaaaagagaaaaaaaauugauuuguaauuauuucaccaauugcccugaaaauaucuaucaaguuuuguugaauucagugcugauaauggucacagguuuccuucugggcccuuccacuuacuucuaacaacaaguauccccuaaaagacugcauguagccaaacacuguuacuguuacauucuuuuagcugcaggauguacuggcccagucuugaaacugcaaggccacaaauaaacucaacaaagcugacgagguuucaaguacccucaaguaaccauagugagcuaaaaagaaacuuacucucaaauuaagaaagggagagagaaaaucauuagaaucaucccacugugcacacugcccccuuaugguccaggccucugaaacaucagucugugcuguaauagggcuucauugcuacuuuaaaaaauagcuccaaacacauacgggaggcagcuugauuuacacugugaggagaggauugaccguagaugcuugaacauuaugcuaauagcuauauguauacuaguauauacauuugggacaaauuauaaaauucuaaggauauaaaauuugcuucuguuaaccauuaauuuaaaaaaaaaaucacaaaagagaaaauccugaaaacucugagaaauauagagucucauuaaaccucaccaagcggcuggcuuugauucgauuguaguagaauuucaaaauuacuccucaggguaaaacaacuucgggggaggggggcauuucuuaaacagaaacauuaagaacuuugccucccauuacuuuaagugauaagcuguuucccugcguaguuuuggugguaauauccaucucucacuaucacuuucaagacgucugaaggaauaagaaccauugagguaaggauauuuuuuaucacaacuaaaugauaagaaaucacaaaaucaucagcaucuuuguaccuuggaccuauacuaugccuaucuuugggaagauugguaauugcccucuaacuccguaguaaguuggacagaggguuaaaucgauauugagaucauuaagucaauaaacaccucuccagcaaauagcaacguagcaccccaucuucucaaaaugacuggggaccagagacggcagccuggcgcucaccguagcaagucaacaucaaccacggucaaccaaccacaagcauuauuaagaauucauacuuacaaaauaguuauucagacuuucuaggcuuucaaugacugugccguggcaguaacagccagaaacagccaugaggaagagcugcaaagccaagaugcaguguguagcguucauugucucagagcuaggccgcaggaggagaagcccagaacuucugucucaagucagaggguccaaaggaucagcugaugugucuucucuaggucagccgauggcagcuaua

SEQ ID NO: 12464 - RNA, 4758 nt, Mus musculus
agugcucucgagcagacuccccaaacacagacaugacccaggcagucaagcucgccuccagaguuuuucaccgaauccaccugccucugcagcuggaugccucgcugggcuccagaggcagugagucgguucuccggagcuugucugacaucccugggcccucuacacucagcuuccuggcugaacucuucugcaaaggggggcuguccaggcugcaugaacugcagguaagggggcaguccuugcccuugguaggacugagcagggagagccggcuuuaauggcagaaaggaccacggugaagaacacaggaaggagggucagugaggguggggaccuguggauuaugaagaacucacgcugggaccauagaagguuccacugccccggagucaauaccuaacucccggcaaagggauguacugucgcuucauacacaguaaacccugcagauccaggacaagcgugcugaaggagggagagcgcugugcuauccugcagaugaagcuuaaagcuacgcgcuccucuucuuucacuagaggcuccucuugagguacaguuaggagaagagcccugaaggaacugcucccccuaggcuagagccagauaacuaaaaagaagugcuaaaugucuacuguuuugccauucucucucaaacuuucaugggaugggagaaaaaguuugccauuugggggcccuacgcuagcccggcacugaaaaagcucccuuuucccaagccuagccaacacccuuggcccuggcacaagccaaacgaaauucacccgcccagguauucaaaugcgccgauucucucaggugcauggcgcugcgcgguacgggccaauauggucuggcagcuuugggacacuucgcacaguuuacguugccgacccuacacuuguggagcagcuccugcgacaagaaagucacuguccagagcgcuguaguuucucaucaugggcagagcaccgucgccgccaccagcgugcuugcggauugcuaacggcgugagucgaccccugagcaccuuauuccugccccgacucccacagccaaguugggcuuggagggaggucggaaguuuccaccaaucuucuggcauuuccccgguucuccagucuguacuccaguccgaacgcagguagagccgauuccucaccccucccugcauguuuggggccaaaauccuacgauuccacgagauaggcgagggcaccagcauuuggcuggaacgugagcaucugugauucaguuuaccauggaacccacucccaucccugagcaggaagugaguaaagaggaacggagaugagagauuggugaggucagggugauuucuacacccggagagagcagacauaauacuccuggucacccuagccuucuccacacacgcucacgucccuaaagucccucucugcacccgggcagggauggugaagaauggcagaggcuccgaagucuucuggccccgcuccuccuccggccacaagcagccgcgggcuaugcuggaacucuggacaacgugguccgugaccuugugcgacgacuaaggcgccagcggggacguggcucugggcuacccggccuaguucuggacguggcaggagaguuuuacaaauuuggccuagaaagugaguccuaaagcagaguuaaggaccuguguagauaguucaggguccuagauggcugaugugugacugugcccccuccuggccagguauaggcgcggugcugcugggaucgcgccugggcugccuagaggcugaagucccuccugacacagaaaccuucauacaugcagugggcucaguguuugugucuacacucuugaccauggcgaugcccaacugguugcaccaccuuauaccuggacccugggcccgccucugccgagacugggaucagauguuugccuuugguaaggcccgggggaggggacuggguaucaauacugcacuggagcagugaggcagcgugccuuccuucucagcccagaggcacguggagcugcgagaaggugaagcugcgaugaggaaccagggaaagccugaggaggauaugccgucugggcaucacuuaacccacuuccuuuuucgggaaaaggugucuguccaguccauaguggggaaugugacagagcuacuacuggcuggaguggacacggugagguucucucuauauugcaagugccauuuccagagugcaguguccauguccaucccugucccaccccacacacacacaccuccugugcucacccuacccccuaccccccaucccgagaacucuagggccacuuuucugauucagggaugaagguuuagcuuuaguaauuccuugguccccgaccacucccucccuaugcuaccccccuucacugggguccccaugucuaacagcucagaugaucucaccuguucccucagguauccaauacgcucuccuggacacucuaugagcuuucccggcaccccgauguccagacugcacuccacucugagaucacagcugggacccguggcuccugugcccacccccauggcacugcucugucccagcugccccuguuaaaggcugugaucaaagaaguguugaggugaugggggaaggaaagcaggaaauagauaaaaugcuagcggggagcagaggaagcuggcaguguguggaaggggguggggggagggaggagagaaaacuggcccccuacuccugcauuuggaagcuggagacaaggggacuggaggcgcuguguuccccagccucacccugcugaauccauuuucuguuucaugaccuagauuguacccugugguaccugggaauucccgugucccagacagagacauccguguaggaaacuauguaauuccccaagaugugaguaaaucuuucugcuaagccauuccuuacugcuuugggcacaagucauucucaaacacuccgggagccuuuccagccccccucccccagcauaaugggaguaguagagggagguccuuaccaacaaccaaggcccacuuuuaaacuggucugcagauccucuucuucacauuccccacccugcugcauucuugggcucagacugaaaacuccgaucccucugcgaggagggguaagguguugagauagagucuugcuauacagcccaggcuggccuugaacucucucucuuccugcuucaguuuucugagggcuggaacugcaaguguggacaugaaacucagcuacugaacugacaagucugucuuucuuucccaccagacgcuagucucccuaugucacuaugccacuucaagggaccccacacaguuuccagaccccaacucuuuuaauccagcucgcuggcugggggaggguccgaccccccacccauuugcaucucuucccuucggcuuuggcaaacggagcugcaucgggagacgcuuggcagagcuugagcuacaaauggcuuugucccaggugagugaucuagaacuuauaccguuuccugucuggaaaggcccaauaaacgugggugaucuugaccucugacaaacauaacaaaacauauaagacucagcagauagacccacugacagucccacguaggucuggaacaucaacaaagauauuuggacuaucauuuucccucccacaacccccugcccucacugaccaagaagucccuuaguggccucagaugccauuccaacaguggccacucuaauguucuuuaccaauuaagguaccauuuuagacccacccacagugacaaccuucuuccccucccccguuuccagaucuugacccauuuugaagugcuaccugagccaggugcucuuccuaucaagcccaugacccggacuguccuggucccugagaggagcaucaaucuacaguuuguagauagauaaccauucggaagacagccaacaucgucucucucaagacaggauggggucuuuguuauacacaagaggcacacucuccuuggaggccugucugaccgagcaaacuccaggaagcagguccugaccuauguguacuuggccugacucagcaggcaucgcagaaccaccaucuuucuccuuccugcucagugccucuccugaucauuccucaggauccaaugccuucagauuuuaacacauccuuaaagugccaacgcagggguuaacuaccaacuccaggcagccuggggagggauucgccccugauccuguaguguucguugaugcucugucuaagcauuuaucacggcacaagcuaagugauugcaucuggucugcaccuggcugcaucucuaccugaccaugugugccuucugagaagaguaaugacuagucuacugggcuuuuagcucuuuuucuuuuugagacagagucuugcuauguauuccaugcuguccuugaacucacaaccuccuugccucaccuucccaaguauuggguuacagacuugagcuaccacuuccagcuguaucagucuuucuaucuccugccagagucuaucccuggcuauucagcaccauacauucucagacugaaccuggaccauguggcaggaucguccacucaccaggcucugcccacccuuuucucucuuaaucuuuccucuagggaaguaaaucugcccuugccuaauuuacagcguuuuuaagccuccgcuaccuugguucuucagccacucucaaguggauccacuucuuaucauccaucuuuuggccugccccuccuccagccugucuuuuuuauauuaaaaauuuuauauauauua

SEQ ID NO: 12465 - RNA, 4181 nt, Mus musculus
uuuguuaaaaaauaacguucuuuuauuucuuuggaaaguagugggcacugcccuacagauuuccaggccaagcgagguaagugaauguuccccuacucuggguuugaguacuauggucccagccuucccaggggcccaggaguguuuuugggccccgaaccaucugaaggcucauaugaggucuuugcuccugaccacugacuuucacuuucuccaucuuuccuggcucucugucuggguggggaauuucucucucccacaccagugcuggaaucugugcuguucacaaugaaaacaagaccagggacacccccaacuuccuaugagaaaagacagucccucaguccuuucucucugccggcucaagucuccacuccugugcaagccuguuugaguugaggccugaaggagagaccccucucaagaguggggagaacacaccagcacaacccugccucaggagaugcuccuaccaaguauauuccuuguagucucuuguccuaguuucugaguggcccuucggacagagccugggagggcuaugcaaguggggaagggccccgugaccccagcccucggaugcuguaacagggaguagaguauccauuaguccugucaguguggcauggcugugaugcgcaugcucugggaagcaaugggguaagucaccauaggaguagugguguggcucauugugauuccugcuaagggcugggccauggacacagccacaggagccacaggagccacagacacagcuacaggggccauggaaacaggugggggugccauccccugggcgauggucugagccagagcggcugacagcggcgugaucucgggguucagguguggaggugggggcggcggagcggcaggaggugcagcauuagucgggggagcagccggugccccugugggagcaacaaguucuugcugggacacaggccgaggcuguagagccuggcugcucagagugguaugagucugggcgaugccaugguuaaaaguggccacugugcccacagugggggccagggucugcucagucgcgggggcaguggagcucagagucaucaccuuggccugauuccggaacugggcauucugcuccagaaguaccucauugguggccagcagguugcugaccugcuucuucagcuccuccacgcguuuccugagcagggcguucuccuccuccagcagucugcacucaaccccacggagcggagccaaguuacauucguaggacucgaaaugggggccgucaggagggcagcagccaccucuccggcgcuuagggccugguucgugguccucaaagccccuuuccggaaggucguagaugucauagagaucaugacggcguccugggggagcagagccuguggagccuccaccuccagugccuccuccaccgcgagcaucaaacucaaaaucccuuugcaggugacgaaacuugcacuuggcuccucucugacagucaccuuugaggaagucgcggcagauggggaccuccuccuuaccauuggguaggucggcgggugagagacccagcccagcggccacuuucugccucagccggggaggcagcucuccugucuucuuauagccauccucauccuccuuggagccguggaugaaacgacaguuggggcggcuacacuccuuguuuuggaagucauggcagaagauaaauucauuuuugcuuacccccaaauuggauaccucacucaugucuggguggcgguaucgacaucgcuugccucguuugcagacguuccucaggaagucucuacagauggcaucugagguggcucccccgcugccugucccugccccacuggccuccucacugccaccaccuccagggccuccaccgcugcugccagugccguuggcauagcugucccggucaggcauccuggucccccccaagucagggucuucuuccuuuucuugccacucuuggcgacuguuaaaaaagagaacugugucagaaagggguccuccggaaagcucccucucuccugaccauacagugggcaggcuucuggggcaauggcuuugggagauggagaauccaaggagaauucuagcuagcccggcugacuugccagaagucccgcccaggcccuuaugcaccuggucuuguuuggagugauucacacuugccuggcuaacacaggagggagagagcugggaugaagccacuucaucuuacuaaugaugcucagccaaggagggggagggaaggggagaguguuagauuuuuaccuucucucauuuaaguugugagggagaaacuaaaacagguguuggugugugaacagacugacacuggaaagagugcucuaacacgggcugcuuagcuuugagaacucauggaagaaggaacaccagaaacagaacuucccuuaaucccucuucuacguaaacucagcucaagucuccauguauuuuagaaaucccugguuaaacaaaacaaaacaaaacaaaacuggugucacuagcuacaggguaacccugaaaccuguccaucucccaguguguuccacacacaaacacccucauuucauggaaagacguucugagcugaacuuucuacuuuuagauccccaggacgaacuguucgaaggacaagguggaaaggaguuacuuucauaggaacggugaccuuucuuuccccauuccccaccccacuccaugaaaaucccacugauaucaaaccauagcacuccuuaccccauaaaaauccucuuuauuuauagacucuauaaaagcuuuuuaagucuccuguuucucaagagagcucuggaaugucaguccacugcccuaauucuagcccucccuucucucuaacccugggagucuaagacugggagucccugcuaccacgugucuaaucuuuuaaauguucccugaguaggacucaggcucccccuacuguucaaauaagagaaguuccuaguuuccguuugggaauaaagauaccuuucuugauuucccguuuccuugacuuccuugacuuugcuagaauaacuaaccagauuagaagucagagaugcacaggaauacacaagaugggaaaaggagccccagaauauaagaaacaacugguaagaaacaagcccuuaaaagaucauaaaugacgaucaggugaagacuaaaugccuucaaagccugaccaauguuucaagucccacuagaagcagauaacuggauaugauagccuuccucaccccaauaucccagaauuaauaccugagguagcucaggugaaguccggggcucccgugagucuccaccuccacaucacugcuggguucugaacaagaaacaaaaaaacaaaaaacggagauuugaguagaacaagggaaaaacgugaaagggauaugaugugguuuucauacacuggaaugaauucugacaaaaagcuaagagcuuuguggcuuuuaggcucccuuaagaggucaaagugaacgucaccuaucacaaggagaagucccuauuaagaaggauaagggcuagaaccgaccaauaaaaauugggaagcugaacuaaaaaacaaaacaguuccuggugaggaagguuagcggagcuuuaccucaagaugagaaggauaugggguucagaauccgaucuaggguuggaguucggaacgccagccaaaccugaaagcuggacaagggcaacaacugacuagugucagugggaaggcgagacuagacucgggggcggugauuacgaccaucccccaacacccuagaguucacgaaaaguccuacgaguuucccuggaagucuucuggcuuggccggcuccgcgaugcggugccagcacucagcgguggaccaggugacugggacacugaggaagugaaaggggaggggggcucggggugacaucaggcggagggaugggcagggcugugacgucacggggcuggcguuugcuugggaagcgaggucagugagaaaaggggcucuguccuggguaacgaggaagagccaggucgguuccgggggguuugggggaggcucguguggccgggcagaacccagucgcugggccauccccgacuccuccccuccgggcgcggccuccaccuaagucucccgccucccucaccugccgccgccgccguaguugcugcugccgccugccgguccucuagcuucg

SEQ ID NO: 12466 - RNA, 14948 nt, Mus musculus
cagggugaggagccaacgccagaggagccucaggaggagagggaagcagaggggcccaacaacgauggugucacccugaagacuggacaacugugcagacuguggagggcugcgagaccacgguaggauucccuugagggggcagggcggaggggcacugcugcaccccacacuuauccccaggaggguagaugguccaucaguugcuccccuguggaucaggggcaccugcuggcccacacaacccuccagcauucgcucucccugucuguaauggaugcauuguaagucaggcuuggaagucucucuuggaggauggccaagcaaagcuggagagaccagcuguggaagugucccguggguuaaaguucacaggauggguaaagggcaguggagagagcacauggauuccaggcuugcauugugccaucgugguagggucagccugauucuaaaggcagucaugauuucugcauccccaggggacucaaaucccuuuucuuuuucuagaguucugagcuugcagaggccucauuuacccuccgguagauggagcaguggagggccgucccuguccauucaaaaugggcugcagcaguccacggggaccaucaugggugcucuggggaacuugaucagccaaggucauuacuccucugccuuugaccuugggccagaucggagcuuggccggucuucgucccccccgcauccgagcuccaggacagugacaaagagagaaaaacaaaaaccaagucugugcaagagcccccugcguugggugcuuggcauccaaaauuccaagaggcucuuaccucuaauuugucaguguuccuccaaaccugcuagggggcugacaaaaggaggggacauuguucccaggauccuguccaugucaugccaugccgggacaggacaguaaggggagccugggacuagucuguacaaccaagugguuuaguuugcuuugauucuugccucuugcugugugaauuugggcaguucauuuuccuucucugggucaccguggcccccugcgaaguugacagucugauccccaccuggaagaacugucaggacaaggugggagcagguagcaggaccaggaaaaggccacugcccccucccccagagccauggcaaggcugugccccauugaccacugaaugugguucuggcaccuccuuguggccagucuuuugggcuacaccuugcagauauuaggacaaagcucuggaagcccccaagaggagccuucuucccuuguguuggugaauggccucugcccacccccauccugcaccccagacacccacucacuuccucaaauccaguuauccagccccacccaccuacugguacggacugaacaggcgagcuggcgagccgacuguacuugcugauucugggcagcagguggcgcugcugaccagggcuuggagcugcuaagcguuuacagggcaaagaacccuaaguucagguuucaagguuauagagggagcccauccacacccccggcgucaaugacuggaucuaaucaaggcaguaggaucucagggagcgaguccucucuggaaucuucacaagcaaacuaguuuggaagucuuggaacccaggacaagcaccagggcauauauuaucaaggauggcccacugacuuguuguguggcuuuggcaaaguggcaugcuuucucugggucucaccuuugcagcuguaccagauaaagaugucuauaauaaagguguaucuuguggcuuugccaacuuaagauugacgauccuguuaucaauuuugcacacgucguagcugagguuuaaaugaugacgccaccugccugagguggcgcaccuuguaaaugacaacuaaaucugagucuaaggucugacagacuccaggguccacggccccucuguuccagcuaacagagucgcacccugcuuggaaagacaggcaaggacucuguguggugguggggggugcuaagaugacuguuacagagaaccaucuucccucuaagauagucuucccucucagccugcagguccaagucuucgcagaggagaugccacagcugaggggugacaugaggguugggcacaggucucaccuggaaaggcagggaacagaagcaggauccaggggucagguggggugagguuagcugggcaggagaucagaguggauuuugucacggagcccuguggcugauaagcacuggcuaccuggagcacuuaggcagcgaggguugcuccccugggaugacuggccccagagcuccugacagaucuugcugcccugagcaucuccuagcugucccaacuacccguuagaugucccuggccuuacuucagagagggcgggcuagggugggaacgcgggguuuugcaucuucggugacccuggacaauucaacuccugagcuucaguuuccaagugugacaaaggagaaaugggagugggcuggaggccuuagggggucuucugagcacucuguaugauuuucuggaguggauuggggggggggugucccugagacuggcaugccaaucuugagcccuggaagggucuucgagauuugcagagaccccagguuuugggacuaguaugagacaagaguugauugacccugugcuuccugacaggauagccaguccuggcuauggcccacuguccgggcagcuccaccugcuucuguccccacagccgaaagcuuauucuuuucuuucccaggaaguagacacuucacucugacgagucuuucucccacccucaccucacuauggaacccuucauucuucucucucaucucccucaugucuccccuuccuaacauccuuggcggguggggggaccuuuuuucaagucuuccuggcacugagguuuguagucagggcucgggccaccuccccagugucaccucuuaguccgguuaaguggcccuugugaguuuaacuagaaggggggacagagaugaggccaggcccuaccucuguggccagcuuccaacuuccugugugucugcccacuguugcuuccuguucuguuuauugccuccaaguucaggaaaccaacgggugccccacccccaccuuacacacccgugauuauuuaauagcagccgugcuacagucucucgcucucuuuuggaaaacccaguggggaaaggaagcugacagcucgagcucugacaucagcguugucccugagccaaaaauccaggguggccggggugggaggggcagggcggggagggaaccaguugcugguggcccccaugacacgaggcugcccuaagguucccagggacgggggccagacaucgaaaggcagagacacaaggacacaugcauauucaugcacagggucaugccuggcuaccacccagacccacacaggcucacacaggcauggacacacacaugcauucauguguguaugcaugcaugcucacacacuuggggugaggggaggacuugcaaagcccagcucuguuuuagccucgugcacacacaaacacucuaaucaagugcauacacacacacacacacacacacacacacacacacacacacacacacacaccagggccagacacugaugaacgcagacucaacacugacaccgcacaagcacaaaagcucccugagacacagacacaggcuccgggaagcuccucauucucagggauucuguagagcgcccucuucuggacgcagcugggccccuggccuaggccacccugaaggagcccagccacuuccuccugugguguguaugaagggccccugaugccuaugagcaaaggcuccguaguugugacuguccccagccucaccuaggcaaggcagggagcccugagggucuaaggcugggggaggaagugguucuggagaagccgggcucugcaagggacuucgucacugcuaggccugaugccaggcuuccacccccacaccaugccucuggccugcccauaccugggcccauaaugcaccucuggcccauuccugagcuggcuuuaguggaagccacaguugaagucaggcacccugugcugcugacugcugacaggccuugggcaagucacauagaccgugugggccaggccuucguuccuguggcuaucuguggacaacugggaagagugcuucagggggccaugcucgcccuggcaauguugauguauuuugucaucccauuuuucuuugaaggugcuacuagcuccuuguaacuuguaccugugacucgugaggugcuagaggccggcgugagagcauuguucuccaucucugugaccuggacauucaggagaauagggccaaaguaugaaugcuuauucaacauguacacaaacuccugaccugggggagagcaaccuaacuuacagaaaaaggaccggaggguaguguuagggugggacuggccaccuaccaugccacacccuggccucuggcccuacugagggucagcucugugggcugcuauuuccuuugcuguuucuagaacugaagagggggaggggaugcagacacucugauucaccucuaggggcuugauuccugacgcagaacuagucaggaagugucggggugaugcuggggcuguuggcuguuggccagacuacuugaggcucuucuuuggcucugagcgggugccauuggugccugccagagaucugguggggggaggguaagaagcugcagauuccauggcagugcucggucugagacaggacugacacaggacggcuugcugauauucuccaaggcugaccacuaccaggguccauguccacccccaaggacugagagacucagaagccaggccagcccuaaccagcaaaguaugcugagucucuccaggccugguccaaacucccuauuccccguuggccagaguugacugagcaucuacccugaauuguuuucagaggggaaacugaggcuuagagaggagccaucaaccagggccacacaggcaguguucggcuacccaguucauccaguguuccacaaguaacaacccuuaaguauuaacuuaaggguaucagcgccacagugccucagagucagggcugcaacucuaaggacacccucauuucucaaggcugacaauggagccgccucugccuuuuggggcacguuaucgacugccuaguccaugccagggacagucucagguuucuccuauuuccuuugacaccugucaccagcuagggccuugagaagcauccuccagcccccaguuuccucucagagcacaguuuugugcucaccuuucagcaauuucaggugagaucgccaaagcccagcugaggcucuguguuuugaagaacugagaucguucaggggaggacgcagggagaacgggggggggggggggggggggggggcuggccugccuguggagcagcucagcaucugggucauuggucuuggggaauucccagugcccagagagcugcuuccuuaccugcugaguaaccacugcccacacaggaugccuggcuggcaggccaccuccccaaaccuugcaagcagucacugcucugcuguccucucuccugagucugagagccccagggcccaggaaagagacagcccagcaagcaggcaaggggcuagcccccacccccgcguuuccccccacccccuacccccgggggcucugcagggggaagcuggugauucaaauuccuuugagcugagcuuuucagauggggucugggggugaaucagcuccuggcugguaagguccaaccagcagcuuucuucaucucaagcccugauugggggugucugcccugugugugugugugugugugugugugugugugugugugugugugugugugugugugaaggguccacuucccaaaagccacagagcauguaccucacugagccaaaucuccagccugcuucuaaaugaggucaaaguccacacaugcuucaaaccaccagagcuccuccuaccuuugcccagaccacuuucaagguguaaaaugcuuaaaaauagacgggaucugcagaguggucccuccugaccaucacugucuggaacagaccccuuuccaagcccccagagcccaagcaaucugugccuacuugaaacaagaaugaacaccaaggcugagugaaugggucaggcugcagggggcugagggguucuuccuucugaaagccauugccuccuagaggggucacuggaucuugcaagccagaagcucugccguuaacucuuuguguauagaucuuuaccugccacccccuuaaccuccauaagugaaaagcaaguggcuaugagguccugggagagaguugugacuguugagugaaagcuaaugggaaaggcaaggcugacuggcccuaugugucaaaguggacagaagagaggacucucaagggcuuugggaaggcccaggcuagcuuagguuuccagaccagucuacaaucucacuuccuggagagaagcacuggauacugcaccugggccuggcauggcagccccuaucccugcugagggauucccuggguggaaacgggcugucccccucauccugaagccugucaaaccccuagcaggcccagugugcaggagcuggacaggcugcagaugaagucacagcuggaagaggcugggcuggggcugccacuccagggcggggcccagggucacaacccugggaacaggcagccaagaagggaggaugucuucugugagggagcagagggaaacacacauacagcggcacagagagggagggacggaugcaaacccccagcucacgccagccacguugcaggcggcuugaagacagaggcucagcucugcuuggagaccuuuccuggugccuccucagaggccugucacagguggugcucagacauggacuggagcaggaggcagggccuggugcaccaaggggcccagagcacugggggagcauggacuaagucagguacugugagaggggaaacugaggcacaaaugagucaacuaguucacugaacucaaaagguccucuuaucagugucuucuggaaccuguucccaccuccuguuuccugcaggguggagccgagaugaaaugacuguugaguggacccaugugggggucuagugauccagagagcagugcaaggccuggaagugcucuggagggauguagaggagagccaggcacaggaguggggccguuagggaugagguccuccgugacuggaacacgcaaugagguguuuagccuugggggcaggagguggauagagaggaccaugauggcuuucugggcugauagaauuggggcccauguaaggacaccaggcagagucagacagcagcuguucggaagacgugaugguggaugagggccgauucagaccuggugugcucugaguaguucuggugcgguggcgcugggaugugugggguguggagucacaugcuaaccuauguguacaggaauggugaaccccagacagggucaccaaugaagagacaaggugugucaggaugcagggagaaagaaagggugccaaccugguggcuucaucacuccacuauucgaggcucugccaaaagaccacaagaaacaagaaucuggagggggcgggguguaugugugggggcggggcaaggagaacagacacaaggcacccugcuaggauaagaacaccugaguagauccugaauauggcucagggcaggagcuagggacaugggggugagcgaaggggcuggagaagccaggcaacgcuuugguaacccuaauugucccacuuggaucugggguuaggucagauggaaagguugggauagggucccccagcgcaaugacaccuccaggucuagaaggacccaauggcucgggauagcauggcccuagguagguguguuuggucagugcucucucgccgaaugcuucucuguacugcuucauaguuaguggggagacccuggucuuauuucagccugucuucuuccccacugucccucagagagucucuaaccuaccagcaaggaccugccucgggauccugccguagaccuguaagaagcaccuguuaggagucaccuuuguacucugaggccaagcacuaggggcuuccaaagagugucagccauuccuaggcacccagaggaagcaggagccccauuuugcccagccucccugaucauugcuuuaggggucccuucaacguaguaaggcugaguucuugcccagauaguucccagauagacgauacaaccucauacucuuaccaguccuccauagagggggcaugcugauggcugggggugggcaagacccucuggcacacuggcagcaagccccuuugugucuucucuuuacccauuggcaauggacaggcuggagaaaggccaccccuaaggugacucccagcguccacauucugcuucacuuuauggcugucuaaaguucaaaagggccccggccccccuucugagaaacugcuucucaguggaaccccagccugacuccuuuugcugccccgcaaagccccaccaccaccaggggacacaaagguaaccuccagucuguugccacccucccaaacccaguugaaacuggaacgucugaaggggggcacaggcugaggaccccucugaaucccccugagacccuuuccccaccagacccaucugcaaaaaacgcccagagcaaaccacuuaggaaaaccacagggcgguuuuuuguuguuguugaagacuucauuauaauuuuaucaaucaaauucuuagaagaaggaaaaagucugcccuccccacccuccccccucacucuuccccccucccccuucacucucacuuucuuccauucauaauuuccuaugaugcaccucaaacaacuuccuggacuggggaucccggcuaaauauagcuguuucucucugucuuacaacacaggcuccaguauauaaaucaggcaaauuccccauuugagcaugaacuucugaaaacggccugcaucuaaggucuccuccaaggcccucuggaguccagcccauaaugaaggucuuggccgcagguaaauccaugcgccgggcgccgauuuaagagucccggcugcgggcgcgccggcagccuggggcgcugggcgagcacccgcgggacacccgcccgccgcgccacucggacacuuggggcgcccgcgcaguccgggcccgccggaggcgcuggguggcggccgggagcgagcgccgcacaugguccgggcaccgcgcgcccagcccgccggggccagcagguuggcggugagggaccuggccggcguagccuugcuccaccgccuucucuccucgccccacugcucuccugugcugcucuuacuucuccgcugucgccuagauuuacccucccucuuucuuuuucuuucuuuccgcuuucucuuuuccaacugcgucccgggcugcucccugggaggggcgcaggcggcugagcagcuugcaaacuccggccaggaccggcgcaggugcggcuuccgucugcuagucccuggaaagcugugauuggcgcgagaugagaugcagguauggguacccccgcagcuauuccggggcccuaacaguguuuggggaugcugagaucaauagaagacuccaggggaguaaacuuaagguucuagggucuuuuuagucccaguauggggaguucaggugggaggucuccagccucccuuaagagaugacuucagccucuaucaccuucuggugucuuuagccugguguuggaaaggcuggagcuggggugagggggccggugaagcuaaaagugaaggacgggcaggcgccccgggggaggggugauccucgacaggcccggacagcucccggcucuccugacaccuuucgcuuuccucuugcguguccgccugcgaccuuuccccaccccggccucuuuccugguugcaccacuuccucucauuccaaaguauguggauuuuuuugggcggggggggggcuguagcaagcaggggugaaagaugauuugguuggagagugggcaccugcagaacaaacagguggaaaguucucuauagggccucauugaggaagaugggauuaaaggcaaucguuuuaggaagccagagucuaguggcaguuuuaagagauggucuacagaaaccccagcucccagccugcacggccugcaagggguucagcucagaguucuaggcuccagugggccaauggacaccaaccaaguuaagaaucuggccgguccuggaaaggggaggacgguuuauuucucuuccccucugcuggaccuaauaccauccaucuaggguaccaggagggaugaggcuagaugguugagugcccccgccccccagaccuagcuuucaguugguacaaauggcucccaccuugauaccuugccucuuaauccaguggcauagauggggaaacugaggccugggagcagggaaagagaaagccagagagccagggaaccucaguagagcaggagacuaaaggcugauggagggugggagggggcaggaagggccucgcugaggugcccccccaacccccgugccgugacccucagccaggcuucuugccuuuccagucacccuccgugucucuuccagggauugugcccuuacugcugcugguucugcacuggaaacacggggcagggagcccucuucccaucaccccuguaaaugccaccugugccauacgccacccaugccacggcaaccucaugaaccagaucaagaaucaacuggcacagcucaauggcagcgccaaugcucucuucauuuccuauguaaguuacuuuccugggguacugaggaaggggggggcugccuggcccggaggggugcccuucagagcuggaagagcgcugugggaacccauggcucccuccccacacccuagccaaagcacagagacuggugggcaccacucgccagcaaguuggggugagcggcggggacugugcuuucugucuugucccauggcucaggguaccaaagaagaggcuaugcagugaauggacagggaggugucauugaaagcaguguguguggggggcccaggaagaggcuggggugacugaaagugcaaguguaugugguguucuggcugaggugacaccugcgacaugccacauuuccucuauccauuuaugucaccgugaccuuggugagugaguucacauuucugaucauugcugacuaaugauucuaguugccuacagggcagcaaguggaguccccaugucacagguggggaaacagaagugcaagagcuugccccaaggguugguggcgggcuagaacacucacccugacucccacaucaccucuccucucuucugcaguacacagcucaaggggagccguuucccaacaacguggaaaagcuaugugcgccuaacaugacagacuucccaucuuuccauggcaacgggacagagaagaccaaguugguggagcuguaucggauggucgcauaccugagcgccucccugaccaauaucacccgggaccagaagguccugaaccccacugccgugagccuccaggucaagcucaaugcuacuauagacgucaugaggggccuccucagcaaugugcuuugccgucugugcaacaaguaccgugugggccacguggaugugccaccuguccccgaccacucugacaaagaagccuuccaaaggaaaaaguuggguugccagcuucuggggacauacaagcaagucauaaguguggugguccaggccuucuagagaggaggucuugaauguaccauggacugagggaccucaggagcaggauccggagguggggagggggcucaaaaugugcugggguuugggacauuguuaaaugcaaaacggggcugcuggcagaccccagggauuuccagguacucacugcacucugggcugggccaugauggaaucuggcaaaguugaaacuuccauaggcagagcuucuauacagcccagcaccagcuagaaauggcaaugaggguguuggucugagagauuucugucucacucacucacucacucacucucacucacucacucacucacucacucagccccuugcuugcuggguguaugaacaagcugcacaaguugucuacagcagacagcaaagggcugggaaguguccuagaccccuacagagucaccaucaucugguccuuugcugucucucagagaaacuuuggaaggcuugguugggaugugagagagcuaaggggacugggauccagaaggaauccuuuuauuuuauuuuauuuuauuuuauuuuauuuuauuuuauaaguuuuguggguggaaggguacccugggguggaaugauggaaugugucuucucuugaguuggaugagagaguucaggcuuagagacugucagauggaagagucuaggucaccaguguucaggcucccacagaagcacagcggccagcuuccaguugucaaagccugacgaacucgguuagcuucuaugcaguuccccccacagccuggcgugguuggggucugccagcuggaccuagaggugaggugugugcaggcaggaagaggcaggcugcaaaggcagguucccagaguccucccggggaaggaccucuaacugucuaggagucagggaaggagcaaggcagccagccauugcugaggcaguagccgacugcagcucucaucugcuucucaaccccugagaacaggugaucuugagcagacagacagguagcauaaaguagaaugucgggucugaggccccggaggucgcaaagguacuugaaggggaccagagggcugucuugggucccuggagcauggagaagcagaacuugaggucagggucucagggaagaugaggcccagagugcuguguuugauccagcacagcugucuauuuauuacuauguccuauuuauauuaacuuauuggugcuuuaaauggcaaaguuaauuccccgaaaugguaugaggcuccuuccaugggagcuggggccgagacucuccaccuaguggggccuggucuggaggcacaugauuguuacaggugcagcucaugggucaaaucagagagcuggcuagcuccucugucucccacugugacucacuuuuagggugucagggucccccagaaaaagcugggccaguuugucucucugcuucugucucugucucuccgagucugucucugucugucucugugucucugucucuuugucucucucugucucugucucucucucucucuccccgccccccccccuucucccucuggucuccaaggggguggaacaguuucuuguuguuuugucccacugagcucucuggcacccccuagauuccugcuaugcggugcaccauucauaaugaagugaauggcucuggaaccuugggcaaaacugauuccuuccucaaaucguagcugaggagugcugaaacauccugacccggcacccagcgugcuuucgaccagcauggaagcuccucggguggcccgaacacccacagagggugaauacaggagguuggagcagugcaggcccugaacugggccugaacagcugcccagugcgccagagaaggggagaucaaggcccgagacgccugggacacagaccaggaagcugugguccuugcuucaucgcugccuucccacucccgcccaugucugggcucccaggcagggaauccgaucugaucucuccuuugugcugaggccaggcaagcagaggaacgcccucgaucugggagcaggguagggaggaaggcagccaagcuggggcaguggcugacuacagagcuagcugccugccucucaggcucugaacagggcgguccuuagcaguucagcagugggauucugcuucacgcgguuuugcaccuuucucugucacucucuaagcacuuuaccuggacggcagguggacaggcccuggagcucuggcuuaggaaaggccuggaaccauagaugcagcaaggagacuauggugggggccacgcgugucagcgacaaaguuacuccaccguacuccuguugcugcgucaggcucaucucaggacuggcugcccuucuccaagcugagagucaauuugucuaaaagccaagaugaugccacagccuggggccuguugggcuuugucaucacuucacauuuguauggacuuggacucucugggcuccgcccaccuggcagcuuugaaggcucagggaccaauggacucucuccgugcacgcccccguccccccaacgcaaccaccuaccugcgucuuacuccaucaguugcccagcaucccagaaccauugagccuuuggggaaaacagacuuuaggggcagguaguugcucaccugacaucuuucaccuggaagcauugacuuccaccgagcauaguagguagugugucuggaccagagaaaaagggauggggcauuuugcaguuuauccagagagaagcaaaggggccuuuauuuauuauuuaaaacuucaaaccugaaagcacugagaguuuacuggucugccccccuccccccacucuugucuauuucuguguccuugaucccgacucaagcaacccagcucugcuuugccugcucucuggagcagacaugguaugugggccaggaccccggagucuugcaugguagcggcuucagaagggaaaugauauggcugucugcauucggaugacuccccagucccagcccagccucuccuuugcacugcugcucucccucuuuccuuuccuuuggaagggacuuggccuugggugacaaauuccucuuugaugaauguacccugugggaauguuucauacugacagauuauuuuuauuuauucaaugucauauuuaaaauauuuauuuuuuauacugaaggagugucuuuuuuuuuuaaagaaaaaaugaaauaauaaagaacucauucuuguuga

SEQ ID NO: 12467 - RNA, 14948 nt, Mus musculus
ucaacaagaaugaguucuuuauuauuucauuuuuucuuuaaaaaaaaaagacacuccuucaguauaaaaaauaaauauuuuaaauaugacauugaauaaauaaaaauaaucugucaguaugaaacauucccacaggguacauucaucaaagaggaauuugucacccaaggccaagucccuuccaaaggaaaggaaagagggagagcagcagugcaaaggagaggcugggcugggacuggggagucauccgaaugcagacagccauaucauuucccuucugaagccgcuaccaugcaagacuccgggguccuggcccacauaccaugucugcuccagagagcaggcaaagcagagcuggguugcuugagucgggaucaaggacacagaaauagacaagaguggggggaggggggcagaccaguaaacucucagugcuuucagguuugaaguuuuaaauaauaaauaaaggccccuuugcuucucucuggauaaacugcaaaaugccccaucccuuuuucucugguccagacacacuaccuacuaugcucgguggaagucaaugcuuccaggugaaagaugucaggugagcaacuaccugccccuaaagucuguuuuccccaaaggcucaaugguucugggaugcugggcaacugauggaguaagacgcagguaggugguugcguuggggggacgggggcgugcacggagagaguccauuggucccugagccuucaaagcugccaggugggcggagcccagagaguccaaguccauacaaaugugaagugaugacaaagcccaacaggccccaggcuguggcaucaucuuggcuuuuagacaaauugacucucagcuuggagaagggcagccaguccugagaugagccugacgcagcaacaggaguacgguggaguaacuuugucgcugacacgcguggcccccaccauagucuccuugcugcaucuaugguuccaggccuuuccuaagccagagcuccagggccuguccaccugccguccagguaaagugcuuagagagugacagagaaaggugcaaaaccgcgugaagcagaaucccacugcugaacugcuaaggaccgcccuguucagagccugagaggcaggcagcuagcucuguagucagccacugccccagcuuggcugccuuccucccuacccugcucccagaucgagggcguuccucugcuugccuggccucagcacaaaggagagaucagaucggauucccugccugggagcccagacaugggcgggagugggaaggcagcgaugaagcaaggaccacagcuuccuggucugugucccaggcgucucgggccuugaucuccccuucucuggcgcacugggcagcuguucaggcccaguucagggccugcacugcuccaaccuccuguauucacccucuguggguguucgggccacccgaggagcuuccaugcuggucgaaagcacgcugggugccgggucaggauguuucagcacuccucagcuacgauuugaggaaggaaucaguuuugcccaagguuccagagccauucacuucauuaugaauggugcaccgcauagcaggaaucuagggggugccagagagcucagugggacaaaacaacaagaaacuguuccacccccuuggagaccagagggagaaggggggggggcggggagagagagagagagacagagacagagagagacaaagagacagagacacagagacagacagagacagacucggagagacagagacagaagcagagagacaaacuggcccagcuuuuucugggggacccugacacccuaaaagugagucacagugggagacagaggagcuagccagcucucugauuugacccaugagcugcaccuguaacaaucaugugccuccagaccaggccccacuagguggagagucucggccccagcucccauggaaggagccucauaccauuucggggaauuaacuuugccauuuaaagcaccaauaaguuaauauaaauaggacauaguaauaaauagacagcugugcuggaucaaacacagcacucugggccucaucuucccugagacccugaccucaaguucugcuucuccaugcuccagggacccaagacagcccucugguccccuucaaguaccuuugcgaccuccggggccucagacccgacauucuacuuuaugcuaccugucugucugcucaagaucaccuguucucagggguugagaagcagaugagagcugcagucggcuacugccucagcaauggcuggcugccuugcuccuucccugacuccuagacaguuagagguccuuccccgggaggacucugggaaccugccuuugcagccugccucuuccugccugcacacaccucaccucuagguccagcuggcagaccccaaccacgccaggcuguggggggaacugcauagaagcuaaccgaguucgucaggcuuugacaacuggaagcuggccgcugugcuucugugggagccugaacacuggugaccuagacucuuccaucugacagucucuaagccugaacucucucauccaacucaagagaagacacauuccaucauuccaccccaggguacccuuccacccacaaaacuuauaaaauaaaauaaaauaaaauaaaauaaaauaaaauaaaaggauuccuucuggaucccaguccccuuagcucucucacaucccaaccaagccuuccaaaguuucucugagagacagcaaaggaccagaugauggugacucuguaggggucuaggacacuucccagcccuuugcugucugcuguagacaacuugugcagcuuguucauacacccagcaagcaaggggcugagugagugagugagugagugagugagagugagugagugagugagugagacagaaaucucucagaccaacacccucauugccauuucuagcuggugcugggcuguauagaagcucugccuauggaaguuucaacuuugccagauuccaucauggcccagcccagagugcagugaguaccuggaaaucccuggggucugccagcagccccguuuugcauuuaacaaugucccaaaccccagcacauuuugagcccccuccccaccuccggauccugcuccugaggucccucaguccaugguacauucaagaccuccucucuagaaggccuggaccaccacacuuaugacuugcuuguauguccccagaagcuggcaacccaacuuuuuccuuuggaaggcuucuuugucagaguggucggggacagguggcacauccacguggcccacacgguacuuguugcacagacggcaaagcacauugcugaggaggccccucaugacgucuauaguagcauugagcuugaccuggaggcucacggcagugggguucaggaccuucuggucccgggugauauuggucagggaggcgcucagguaugcgaccauccgauacagcuccaccaacuuggucuucucugucccguugccauggaaagaugggaagucugucauguuaggcgcacauagcuuuuccacguuguugggaaacggcuccccuugagcuguguacugcagaagagaggagaggugaugugggagucagggugaguguucuagcccgccaccaacccuuggggcaagcucuugcacuucuguuuccccaccugugacauggggacuccacuugcugcccuguaggcaacuagaaucauuagucagcaaugaucagaaaugugaacucacucaccaaggucacggugacauaaauggauagaggaaauguggcaugucgcaggugucaccucagccagaacaccacauacacuugcacuuucagucaccccagccucuuccugggccccccacacacacugcuuucaaugacaccucccuguccauucacugcauagccucuucuuugguacccugagccaugggacaagacagaaagcacaguccccgccgcucaccccaacuugcuggcgaguggugcccaccagucucugugcuuuggcuaggguguggggagggagccauggguucccacagcgcucuuccagcucugaagggcaccccuccgggccaggcagccccccccuuccucaguaccccaggaaaguaacuuacauaggaaaugaagagagcauuggcgcugccauugagcugugccaguugauucuugaucugguucaugagguugccguggcauggguggcguauggcacagguggcauuuacaggggugaugggaagagggcucccugccccguguuuccagugcagaaccagcagcaguaagggcacaaucccuggaagagacacggagggugacuggaaaggcaagaagccuggcugagggucacggcacggggguugggggggcaccucagcgaggcccuuccugcccccucccacccuccaucagccuuuagucuccugcucuacugagguucccuggcucucuggcuuucucuuucccugcucccaggccucaguuuccccaucuaugccacuggauuaagaggcaagguaucaaggugggagccauuuguaccaacugaaagcuaggucuggggggcgggggcacucaaccaucuagccucaucccuccugguacccuagauggaugguauuagguccagcagaggggaagagaaauaaaccguccuccccuuuccaggaccggccagauucuuaacuugguugguguccauuggcccacuggagccuagaacucugagcugaaccccuugcaggccgugcaggcugggagcugggguuucuguagaccaucucuuaaaacugccacuagacucuggcuuccuaaaacgauugccuuuaaucccaucuuccucaaugaggcccuauagagaacuuuccaccuguuuguucugcaggugcccacucuccaaccaaaucaucuuucaccccugcuugcuacagccccccccccgcccaaaaaaauccacauacuuuggaaugagaggaaguggugcaaccaggaaagaggccgggguggggaaaggucgcaggcggacacgcaagaggaaagcgaaaggugucaggagagccgggagcuguccgggccugucgaggaucaccccucccccggggcgccugcccguccuucacuuuuagcuucaccggcccccucaccccagcuccagccuuuccaacaccaggcuaaagacaccagaaggugauagaggcugaagucaucucuuaagggaggcuggagaccucccaccugaacuccccauacugggacuaaaaagacccuagaaccuuaaguuuacuccccuggagucuucuauugaucucagcauccccaaacacuguuagggccccggaauagcugcggggguacccauaccugcaucucaucucgcgccaaucacagcuuuccagggacuagcagacggaagccgcaccugcgccgguccuggccggaguuugcaagcugcucagccgccugcgccccucccagggagcagcccgggacgcaguuggaaaagagaaagcggaaagaaagaaaaagaaagagggaggguaaaucuaggcgacagcggagaaguaagagcagcacaggagagcaguggggcgaggagagaaggcgguggagcaaggcuacgccggccaggucccucaccgccaaccugcuggccccggcgggcugggcgcgcggugcccggaccaugugcggcgcucgcucccggccgccacccagcgccuccggcgggcccggacugcgcgggcgccccaaguguccgaguggcgcggcgggcgggugucccgcgggugcucgcccagcgccccaggcugccggcgcgcccgcagccgggacucuuaaaucggcgcccggcgcauggauuuaccugcggccaagaccuucauuaugggcuggacuccagagggccuuggaggagaccuuagaugcaggccguuuucagaaguucaugcucaaauggggaauuugccugauuuauauacuggagccuguguuguaagacagagagaaacagcuauauuuagccgggauccccaguccaggaaguuguuugaggugcaucauaggaaauuaugaauggaagaaagugagagugaagggggaggggggaagagugaggggggaggguggggagggcagacuuuuuccuucuucuaagaauuugauugauaaaauuauaaugaagucuucaacaacaacaaaaaaccgcccugugguuuuccuaagugguuugcucugggcguuuuuugcagaugggucugguggggaaagggucucagggggauucagagggguccucagccugugccccccuucagacguuccaguuucaacuggguuugggaggguggcaacagacuggagguuaccuuuguguccccugguggugguggggcuuugcggggcagcaaaaggagucaggcugggguuccacugagaagcaguuucucagaaggggggccggggcccuuuugaacuuuagacagccauaaagugaagcagaauguggacgcugggagucaccuuagggguggccuuucuccagccuguccauugccaauggguaaagagaagacacaaaggggcuugcugccagugugccagagggucuugcccacccccagccaucagcaugcccccucuauggaggacugguaagaguaugagguuguaucgucuaucugggaacuaucugggcaagaacucagccuuacuacguugaagggaccccuaaagcaaugaucagggaggcugggcaaaauggggcuccugcuuccucugggugccuaggaauggcugacacucuuuggaagccccuagugcuuggccucagaguacaaaggugacuccuaacaggugcuucuuacaggucuacggcaggaucccgaggcagguccuugcugguagguuagagacucucugagggacaguggggaagaagacaggcugaaauaagaccagggucuccccacuaacuaugaagcaguacagagaagcauucggcgagagagcacugaccaaacacaccuaccuagggccaugcuaucccgagccauuggguccuucuagaccuggaggugucauugcgcugggggacccuaucccaaccuuuccaucugaccuaaccccagauccaagugggacaauuaggguuaccaaagcguugccuggcuucuccagccccuucgcucacccccaugucccuagcuccugcccugagccauauucaggaucuacucagguguucuuauccuagcagggugccuugugucuguucuccuugccccgcccccacacauacaccccgcccccuccagauucuuguuucuuguggucuuuuggcagagccucgaauaguggagugaugaagccaccagguuggcacccuuucuuucucccugcauccugacacaccuugucucuucauuggugacccugucugggguucaccauuccuguacacauagguuagcaugugacuccacaccccacacaucccagcgccaccgcaccagaacuacucagagcacaccaggucugaaucggcccucauccaccaucacgucuuccgaacagcugcugucugacucugccugguguccuuacaugggccccaauucuaucagcccagaaagccaucaugguccucucuauccaccuccugcccccaaggcuaaacaccucauugcguguuccagucacggaggaccucaucccuaacggccccacuccugugccuggcucuccucuacaucccuccagagcacuuccaggccuugcacugcucucuggaucacuagacccccacauggguccacucaacagucauuucaucucggcuccacccugcaggaaacaggaggugggaacagguuccagaagacacugauaagaggaccuuuugaguucagugaacuaguugacucauuugugccucaguuuccccucucacaguaccugacuuaguccaugcucccccagugcucugggccccuuggugcaccaggcccugccuccugcuccaguccaugucugagcaccaccugugacaggccucugaggaggcaccaggaaaggucuccaagcagagcugagccucugucuucaagccgccugcaacguggcuggcgugagcuggggguuugcauccgucccucccucucugugccgcuguauguguguuucccucugcucccucacagaagacauccucccuucuuggcugccuguucccaggguugugacccugggccccgcccuggaguggcagccccagcccagccucuuccagcugugacuucaucugcagccuguccagcuccugcacacugggccugcuagggguuugacaggcuucaggaugagggggacagcccguuuccacccagggaaucccucagcagggauaggggcugccaugccaggcccaggugcaguauccagugcuucucuccaggaagugagauuguagacuggucuggaaaccuaagcuagccugggccuucccaaagcccuugagaguccucucuucuguccacuuugacacauagggccagucagccuugccuuucccauuagcuuucacucaacagucacaacucucucccaggaccucauagccacuugcuuuucacuuauggagguuaaggggguggcagguaaagaucuauacacaaagaguuaacggcagagcuucuggcuugcaagauccagugaccccucuaggaggcaauggcuuucagaaggaagaaccccucagcccccugcagccugacccauucacucagccuugguguucauucuuguuucaaguaggcacagauugcuugggcucugggggcuuggaaaggggucuguuccagacagugauggucaggagggaccacucugcagaucccgucuauuuuuaagcauuuuacaccuugaaaguggucugggcaaagguaggaggagcucuggugguuugaagcauguguggacuuugaccucauuuagaagcaggcuggagauuuggcucagugagguacaugcucuguggcuuuugggaaguggacccuucacacacacacacacacacacacacacacacacacacacacacacacacacacacagggcagacacccccaaucagggcuugagaugaagaaagcugcugguuggaccuuaccagccaggagcugauucacccccagaccccaucugaaaagcucagcucaaaggaauuugaaucaccagcuucccccugcagagcccccggggguaggggguggggggaaacgcgggggugggggcuagccccuugccugcuugcugggcugucucuuuccugggcccuggggcucucagacucaggagagaggacagcagagcagugacugcuugcaagguuuggggagguggccugccagccaggcauccugugugggcagugguuacucagcagguaaggaagcagcucucugggcacugggaauuccccaagaccaaugacccagaugcugagcugcuccacaggcaggccagcccccccccccccccccccccccccguucucccugcguccuccccugaacgaucucaguucuucaaaacacagagccucagcugggcuuuggcgaucucaccugaaauugcugaaaggugagcacaaaacugugcucugagaggaaacugggggcuggaggaugcuucucaaggcccuagcuggugacaggugucaaaggaaauaggagaaaccugagacugucccuggcauggacuaggcagucgauaacgugccccaaaaggcagaggcggcuccauugucagccuugagaaaugaggguguccuuagaguugcagcccugacucugaggcacuguggcgcugauacccuuaaguuaauacuuaaggguuguuacuuguggaacacuggaugaacuggguagccgaacacugccuguguggcccugguugauggcuccucucuaagccucaguuuccccucugaaaacaauucaggguagaugcucagucaacucuggccaacggggaauagggaguuuggaccaggccuggagagacucagcauacuuugcugguuagggcuggccuggcuucugagucucucaguccuuggggguggacauggacccugguaguggucagccuuggagaauaucagcaagccguccugugucaguccugucucagaccgagcacugccauggaaucugcagcuucuuacccuccccccaccagaucucuggcaggcaccaauggcacccgcucagagccaaagaagagccucaaguagucuggccaacagccaacagccccagcaucaccccgacacuuccugacuaguucugcgucaggaaucaagccccuagaggugaaucagagugucugcauccccucccccucuucaguucuagaaacagcaaaggaaauagcagcccacagagcugacccucaguagggccagaggccaggguguggcaugguagguggccagucccacccuaacacuacccuccgguccuuuuucuguaaguuagguugcucucccccaggucaggaguuuguguacauguugaauaagcauucauacuuuggcccuauucuccugaauguccaggucacagagauggagaacaaugcucucacgccggccucuagcaccucacgagucacagguacaaguuacaaggagcuaguagcaccuucaaagaaaaaugggaugacaaaauacaucaacauugccagggcgagcauggcccccugaagcacucuucccaguuguccacagauagccacaggaacgaaggccuggcccacacggucuaugugacuugcccaaggccugucagcagucagcagcacagggugccugacuucaacuguggcuuccacuaaagccagcucaggaaugggccagaggugcauuaugggcccagguaugggcaggccagaggcaugguguggggguggaagccuggcaucaggccuagcagugacgaagucccuugcagagcccggcuucuccagaaccacuuccucccccagccuuagacccucagggcucccugccuugccuaggugaggcuggggacagucacaacuacggagccuuugcucauaggcaucaggggcccuucauacacaccacaggaggaaguggcugggcuccuucaggguggccuaggccaggggcccagcugcguccagaagagggcgcucuacagaaucccugagaaugaggagcuucccggagccugugucugugucucagggagcuuuugugcuugugcggugucaguguugagucugcguucaucagugucuggcccugguguguguguguguguguguguguguguguguguguguguguguguguguaugcacuugauuagaguguuugugugugcacgaggcuaaaacagagcugggcuuugcaaguccuccccucaccccaagugugugagcaugcaugcauacacacaugaaugcauguguguguccaugccugugugagccugugugggucugggugguagccaggcaugacccugugcaugaauaugcauguguccuugugucucugccuuucgaugucuggcccccgucccugggaaccuuagggcagccucgugucaugggggccaccagcaacugguucccuccccgcccugccccucccaccccggccacccuggauuuuuggcucagggacaacgcugaugucagagcucgagcugucagcuuccuuuccccacuggguuuuccaaaagagagcgagagacuguagcacggcugcuauuaaauaaucacggguguguaagguggggguggggcacccguugguuuccugaacuuggaggcaauaaacagaacaggaagcaacagugggcagacacacaggaaguuggaagcuggccacagagguagggccuggccucaucucuguccccccuucuaguuaaacucacaagggccacuuaaccggacuaagaggugacacuggggagguggcccgagcccugacuacaaaccucagugccaggaagacuugaaaaaagguccccccacccgccaaggauguuaggaaggggagacaugagggagaugagagagaagaaugaaggguuccauagugaggugagggugggagaaagacucgucagagugaagugucuacuuccugggaaagaaaagaauaagcuuucggcuguggggacagaagcagguggagcugcccggacagugggccauagccaggacuggcuauccugucaggaagcacagggucaaucaacucuugucucauacuagucccaaaaccuggggucucugcaaaucucgaagacccuuccagggcucaagauuggcaugccagucucagggacaccccccccccaauccacuccagaaaaucauacagagugcucagaagacccccuaaggccuccagcccacucccauuucuccuuugucacacuuggaaacugaagcucaggaguugaauuguccagggucaccgaagaugcaaaaccccgcguucccacccuagcccgcccucucugaaguaaggccagggacaucuaacggguaguugggacagcuaggagaugcucagggcagcaagaucugucaggagcucuggggccagucaucccaggggagcaacccucgcugccuaagugcuccagguagccagugcuuaucagccacagggcuccgugacaaaauccacucugaucuccugcccagcuaaccucaccccaccugaccccuggauccugcuucuguucccugccuuuccaggugagaccugugcccaacccucaugucaccccucagcuguggcaucuccucugcgaagacuuggaccugcaggcugagagggaagacuaucuuagagggaagaugguucucuguaacagucaucuuagcaccccccaccaccacacagaguccuugccugucuuuccaagcagggugcgacucuguuagcuggaacagaggggccguggacccuggagucugucagaccuuagacucagauuuaguugucauuuacaaggugcgccaccucaggcagguggcgucaucauuuaaaccucagcuacgacgugugcaaaauugauaacaggaucgucaaucuuaaguuggcaaagccacaagauacaccuuuauuauagacaucuuuaucugguacagcugcaaaggugagacccagagaaagcaugccacuuugccaaagccacacaacaagucagugggccauccuugauaauauaugcccuggugcuuguccuggguuccaagacuuccaaacuaguuugcuugugaagauuccagagaggacucgcucccugagauccuacugccuugauuagauccagucauugacgccggggguguggaugggcucccucuauaaccuugaaaccugaacuuaggguucuuugcccuguaaacgcuuagcagcuccaagcccuggucagcagcgccaccugcugcccagaaucagcaaguacagucggcucgccagcucgccuguucaguccguaccaguagguggguggggcuggauaacuggauuugaggaagugagugggugucuggggugcaggaugggggugggcagaggccauucaccaacacaagggaagaaggcuccucuugggggcuuccagagcuuuguccuaauaucugcaagguguagcccaaaagacuggccacaaggaggugccagaaccacauucaguggucaauggggcacagccuugccauggcucugggggagggggcaguggccuuuuccugguccugcuaccugcucccaccuuguccugacaguucuuccagguggggaucagacugucaacuucgcagggggccacggugacccagagaaggaaaaugaacugcccaaauucacacagcaagaggcaagaaucaaagcaaacuaaaccacuugguuguacagacuagucccaggcuccccuuacuguccugucccggcauggcaugacauggacaggauccugggaacaauguccccuccuuuugucagcccccuagcagguuuggaggaacacugacaaauuagagguaagagccucuuggaauuuuggaugccaagcacccaacgcagggggcucuugcacagacuugguuuuuguuuuucucucuuugucacuguccuggagcucggaugcgggggggacgaagaccggccaagcuccgaucuggcccaaggucaaaggcagaggaguaaugaccuuggcugaucaaguuccccagagcacccaugaugguccccguggacugcugcagcccauuuugaauggacagggacggcccuccacugcuccaucuaccggaggguaaaugaggccucugcaagcucagaacucuagaaaaagaaaagggauuugaguccccuggggaugcagaaaucaugacugccuuuagaaucaggcugacccuaccacgauggcacaaugcaagccuggaauccaugugcucucuccacugcccuuuacccauccugugaacuuuaacccacgggacacuuccacagcuggucucuccagcuuugcuuggccauccuccaagagagacuuccaagccugacuuacaaugcauccauuacagacagggagagcgaaugcuggaggguugugugggccagcaggugccccugauccacaggggagcaacugauggaccaucuacccuccuggggauaaguguggggugcagcagugccccuccgcccugcccccucaagggaauccuaccguggucucgcagcccuccacagucugcacaguuguccagucuucagggugacaccaucguuguugggccccucugcuucccucuccuccugaggcuccucuggcguuggcuccucacccug

SEQ ID NO: 12468 - RNA, 6736 nt, Mus musculus
guugcauuucaaucauuuuauugaaagguguauucaaaacauaaugguaguugguuaguuaacuucuguccacuccaaaucaauauuguuuucagacugaagccuaucaaccuuuaggaagaacugaaguguucucaguguaacgugguuuacagagguuaaggauaaaauacacccguucuuugguuuauuguucagcuucucaauggauaauuuucuuauccauuacaugucaaaaugguuccagcuacucuagguugacucaggcuguccagggcccugagcugcugccuauguuuuaacaguguggaucauacauucaagccagcauggagacucugagcacaacggcucuuauaauuauggaggugucuccuuacgucccauaagacuuagagaaagguuuugcagauaaacucagcaauuuuauuucuuuuaaaauaaaauucuccauuagaagcaauggcaguuuuauagaaacagucuguaguaaaaaugucuggaguguuuuaucaagccuaaacuaacuuuagugcaauaaauacauuuucagagugauaauucauccaguuauuaagacaguaaagacaauucucucaaaugggauuagauugaagcagcaguucugacaaauuuuucuuuuauuauggauacaaacaccuauucucuagaagaaauauuaaagguaacaaauuuucaaaacuugugauaucugcuuuauauaaaacacccacaauuuuaaauguaauucucauagcaauaaaaaaaaaucccaccuguaaauuaacuauuacuugguuaugggugccaagaaaccauuuaccgcuuaaguaccccuuuuaauaccuuaaaagugcauucaugaaauguugguuuuuauguaaaccucauaauuuaaauuuugagauuuaaauuaagcaguuuaccauuuuuaauaccaccuaagaauauauugaucaaaucugggaagucagaugaacuuuagaaugaagguucacaguuuuauuucacauuuaugucuuuagccuugauuugaaugcuuccugggugaauucaaaucuaagcguagcucucccaagcuuagaaucaggaguuucccuaaccgugaggccauucugccaaggcuacuguggcaaggugcugagguuucucagaguaaauccuguaccguaggaaacucaggucagaguggcagaaagacuugagggaccguuuuugcugcugcuguaauccugcuacauaggcaaacaacacagacccaacuuaacagaaaucugccuacaaacugcgagcugcuaaaggugaacuggugauaucucagacgcaugaucauguauuuccugcgggggguggugagguaugugcauaugugagagaacuugggaguucuucguucucuccuuccaucauguggguccugaagaaugaagucagguugucaggcuucccuucuaaaccaucuucccugacuucccagcaacauuuaccccugguguuugguuguuuugaguguuuuugagacaaggucucuagcugucuuggaacucacuguguagaccagccuggcuuugaacucagagaucuaccugucucugccucucuagugcugggauuaaaggcaugugcugccaugcauuaaggaaaaaauuguuuuuaaucauaaaaagauaaaucuuugcuaugauuaagaaauuuagaugucaaaaauguguauguaucagagaccaauuuuauauuuucaugcauauaauuacuuuguauuaguccaaaugcuauagagguaaaauacuagcuauagaauuaagacacucuggcaguuuccagaaaccuaacaugggcaugcccuauauuacuuuguaaguccaucacccagguuuguacuucauuuucauagucgaugggcagauuaaaauuuguucauauaugggucacauugcuuguuguucugcaugggcuuaugcaacuuuaaauaagcuacaguggggugguacguaauuuaaagaagugcuauuucaguaacuacuuuuaaaauucgaguuuaaaguauucucuuugcuacuacgcuaaucuuuugaugaaaaguauuagcguauaucuagggguuugauaugucuuuucucuuaaaacugcuacgcacuguacacagugaaugccuuccaguauucucuaucuagaccagucaacaauucacuuuuccuuuauguuuucaucccauauucuuuauauugaagauaguauuucaauucuucaguuguagcagaaaaugaucauacuggaaaauuuucuguauacagagaauaacaaccagauuuaucaacuaacaaauggucucaggaaucguugggaggugaguuauucuauaauaacugugcuucaguugccgugcagugcguccagacacaauccauuucaacuucugaccguuagguuuggagcacuuguuugaugaauauucaguuaaacacuuggaaacaagcucuugccagaaggucaaaucucggccacuuaucuguacauaaauuaaaaaaaaaagccccacuguauuuauaguaauauauucucauuaauauccacaucauccaaagggaacuaagggagaaccauguaagcuucagaucaauacacagcgucuuguucuacuuuagcacguacaguggauacauuucucuuguagcuugcuaauaggaccagugcuauaaccuuggcauaccuuggaauguuucugaauacauucuacuccuucuguuaacucuacguauuucagugcuuggaucuccaacgcaaggauagauagcgccagcacagaaggcugaaaaggauaaauauaaaguaaaugucaaugacaaaaauagguuucuguaauuaggauuaaucauauaaaauauguaccuuugccuuagaaaauaugauccugcaguggcaggccuuaaguugggcuucuagucuuucaaaauucagaucguuucuccuuuaaaaagaaaaugggauugauuuuauguggacauaucuaguuggcaguuuuaaaaauguauugaagguaguuuuuaaaauaaaacucauacacacuauauaaaaauuauuuuaagaaaaggaaauucucuccuaucagugucaggaacgucuuaaacgaguuuuaaaugauucuggucaaaaaccauuuagugaacaguaguauaccacaaauaccaugauuuuauuucaauaaaaauucugcaucuuuugaauguauuucgauaauuuauguuaaauguuuauuuccuagguucuguagaguagaaacgugccacuuaucuguacauaaauuaaaaaacaaaagccccacugcauuuauaguaauauauucucauuaauauguuucuuaagaaggaacuuucacuaaaugacuggcaggcaucuuuucacuucuguuaggcagcaaaguacaagggaccauagguccuuauuuugauccgaauucuaugaugaaaaucccgauuuuaugaaaccuucagacaguaucccuuugauuuccaagcuuuuuuuuuuuuuuuuguucgaaacaaauuucacauaccucucaaauggcaaggugucgugaacgagugaauaauagagcugcagaaauugaaaggcaguaguagcuuugacuuuccaacacacuuucuccaacacaaucuucuccauucucaucaggucugaaaccgugaaccuauacugacuuauucggaucaaaucagucgccagugggacauuccuuuccucuucagucgcuuucacagccaaauaaaagcagcucaguccaacacacccaagaugcuucgccuguaccuacaaacacaccagugucuuuacagugcuucaguaggacacagagggaaccuaggacgacucagaccgucauuaugaaaaguauaucaagacaaaucgcuacaacagauuugacaggagccugacagucuucuguacccuacuugaaaccaguggcuuuggguggauagggaagauaguugcugucuuaagaguuaagcuuugaaagccauaugaauauuuugucaguuacugggaaauaacuccguaaacccuuccuuuucuauugcaugcaaccuggagcuggaaaugccagauggcuaagggaauuagaauuuuuauauauggguaguaauuaagaaauacacccuaauuccuaauccacaaccuaacauucagacuuuaacggagauuuaacuuuaaaucuaugaugugaauagaugaguggaaauauccagucuaucaagaaagguuuugauuggggcuagugugguggcucagugggaaaggcggcugaugaccuggguucaauccccaggauccguauuccugcagugguccucaucucuacauaauauugcagcauggguguguccauaugcacacaaacacacacaaacauacaaauauauguaagacaguuuuuaagaaauuucuauguuuuuguuuuuuguuuuuuguuuuaauuuuuaucuuuugaaauggucucacuguguauccuugacuguccuggaagucacuaugucuaccuggcuggccucgaacucacagaaaccugccugucuuugccauccgagugcuaggauuaaaggcauuucaccaggcccuuaauuuuauuuugauuauuccucuguguaagggagaguuagcuaggagggcgugugucugcccuaguguaugugugaaggucagaggacagauuuggggacuugguucauucucuucacuuaaguguuccagggacagcacucagacuugacucucugaggccuguguaacaaguacucucuguguucagcuacuuugcuggcucaagacaguuuguuacauagagccagcuuucccgcuacuggaguacuacaauuaauggcuugauguuaaauuacuuucuacuucaguauacaacuaauaagugauguuuuacaagucuucauuauggaaaggaagcauugccacauuugaaagugguuuuuguauaccagcccuaauccagaaauuugauggcuuuuuuuccuuuuuauuaauuugaugugugugugaguguguuugguacauuugugcaugugccagaggaggcuagaagagggccucagauuucaacugcccaccuagcuguuggaacuuaauuuagauuuucuggaagaccaacaugcacuccuagcuacugagccauuucuccagcccucugcaauuugaucucuuaaacacauggagcgaaauuaagagcugagauauuguaacauaaacauaccuucauuuuagacaagaaucuguccaguaaauucacagcuagggaaaaugucuccgugucaaagccaaagaacugaguuagacuaaguagaucuuuuacuucaaagucccguaaucuugcagucauucugaggccauuaucaugggccgacucaauuaguuucaagccgcagaccuuuggcugacaucuagacuccuguuccaacaggguguucagcugguguagcaguuucugagagucaguugucaguacuucuaucaucuauaaauagaacaaacccagaaaagagcauaagaacccugccuggcuaucucugcauuguggcaaaaagugcuuuauagugcaugcccccuccaccccccaccccauuuccauuacgucuaagacgaagacacugcaaagccaaggucuguaaguauuuuuaccuucucccaguaggucacauuccuaaauugugaguuuguauaggacauaaacuauggcuuaaaaauuuuuuuucucuacuuaagcaaagacuucuucauugucaguacaugccacaaauagauacugccccacaugauacacccaaacuaaaagucaaaugauaguacauacucugccauauauguuaacaacgugaaccuuaguuccuuaccuaugaaguagaaauacgauuauuaccuacaaucucauagcucauagauuggguagcuuaaaaggagucacacaaaccgcuuagcacacaggugcccauuuauuuccagguaaugagcuuauuuuuacaccugugaaaugagggugacaacaucuguuucuuggaguggcugugaauaacacacgauaugacucaguguggcacggugcuuagcacucagugcuccgaauagucuaacgccauuuaaaaaccaaaagaaaaaguuaggugaagcuggggaguugcauugguggaaguaugcauuacacuuccucugaguccugggcacaaccuaagcccuggauacagaggacgauucuucccugggcaguuuaaagaugugacaggaaggucgucuuggugaggaaccacuaacucaguucaggggugcagguugggacugggaggcaugacauaggaauaccgcucccgcugcgccucucucuaggcgcagacuagcccgggcuugcguuccggagugcaggguucugagauccaccccauaguccccucucaccuugacagccacgucuucaccacggugaccacccaccccgggccugcucucagcucgccccacguccccgauccgacaggccuacuaaggggacggacuagggagugggggucaagugagcagaggcccggggaggggccggcgucccgguggagggucccucagcgcccugaccaaguacugccuuccucggggucagcgcgcagcgaaggacugcgccgggcagugggggaacaagcuggagaccuggcucucuagcugggacgcaucuacgucgcugauuggu

SEQ ID NO: 12469 - RNA, 1510 nt, Mus musculus
gcuguucuagcuggguuuauuaagguacagaggaaggagaaaggugugagcagcaggguuuccagcucuuguuaaagaaaaauaucucgucaggcaucucgucaggcagaauuuucccagguuccccucaaccgaacauugucaggacccccuggaaaagagaagccaagcuugagagugcccuucacugcuaccgaggauugcugaggagaggaccuggguacccgagcuuacucaagacaggaaggcauaguagcugguucuggggagggucucuguaaagcccauagggagagagccuuaggacaaacgucauggcuggcuggcagccacuugcgaaagguaaacccugaacaacucuuuggagucuucccaguuuuguuaggauauggcuugcuggagcagaucaggaagcaaggcucucucucucucucucuuucugauguggaaggugucuggggagggguaaccacccaggaggaaguaaccacgaaaggaagaugcccauguuaccagcagugacuucacagcuccuacagccucagggcccagcucggugacacacuuccuggaucccucuaugagaggauccaaugggaugcccaugcuggccaggaugaaccucaggauggccaaguggcuuaaugguaggcuaggcacagccccugccacagccucugcagcuggagcaagggcggccacggguucuaccgcaggcuuggccaaugaguccaugaagaaagcaacaccugccaauacaaacagagaaccuagggccuucucaaagauucugaagaccuaacuccuccagggagggcacccaagggagaagucauagccacccuccuacuucuugauugauggcugcccugugucaagggagaugccaacagaaguuaggaaagguggccauauauugggcccaggaaggagauggcuacagagagagagccauaggagauggguaagguuuuuagaguuggggacauucauacugugccuugcugauuguggggacauuaaccagguugagagcagaugggauggguggcaucaauccagggcuggcccuugaagaugucaucagacuagugggugagcugaaggugaguagguggauaugugagugagaggcagcucggaggcucaggugggacucagguugcgcugacagcagaaagcuuuaaaggaucauaggaaaaauagaggaaacccuggaagggauaagcagaggagcaucuggguuccccuguagacaacucugcuagaauagcucccaucaacaucugcacaagagugaaggcuauaugguaaaaaccagcuggagcagucaguggccaggaaaaagcagguaacaauggcagauccuccauaggagauacuaagcccccaagggaacucaccagagucacugagcagagccacacagagcacuagaaagguggugguaagcuucaugguagaaugagucucagaagaugcucccaggaccuauaagacaaucuuccug

SEQ ID NO: 12470 - RNA, 36703 nt, Mus musculus
ccgaaaacaauuuuaagauggcggcggcagcggcgcggaaaacaauggggcagggguauagcggacaggccgaagccugaggcgggcgguguuccccggccuggaaucgggccgagcggggccggaggaagacccgccgccgcgcccgagcccgcuccacagcccggccggacauggcgcgggcgugaggcggauccgggccgucagaagcggaggaacccgaaguggcagccggcgccgggaggcccgggcccggccagugccgcccgcggcccauggugcuacccaccugccccauggcggaguucgcgcugccgcggcacagcgcggucauggagcgccuccgccggcgcaucgaacugugccggcgccaccacagcaccugugaggcccgcuacgaggcugugucucccgagcgccuggagcucgagcgccagcacaccuuugcccugcaccagcgcugcauccaggccaaggccaagcgcgccggcaagcaccggcagccgccggccgccgccacggccccgguugccgcuccggcccccgccucggccccggcggccgcgcgccuggacgcagcggacggcccggagcacggccgcccggucgcggugaguaaggcuggcgccugccacagcaauacucacucccgaaaacgccucuuccggcgcggaucgggccuuggggaaacuuucccgagcgcccccauuucuuagucuggguccugggagguggcuaacauggcagggcgcuugucaucuuccagaaguggcacugcgguguacuuugggaaaacguccccuugaggacuugagugaaaucggggcuggaaaagcaggagguuaguugcugguaggcuuuucuccuaaacuuaauuuccaauugaugagaacuucgucuuggagcagacccgcguuggaguugccuaggauguagggcguucuugcaccguaggccuggccucgcuuagucugcagauguugauuggaucuuugcuucguggagguuaguuagggcuuuaauauggaaauaagucucccuucaguugacaguaucccgcgguuucggaauggaaaauugaaaagucuuuggaagcuucgguaaacggaguugcuuaaaaggcauucguuuucccccaacccccgcaaaagggaacuuuggaauuugugaacgccugauuccugcuauauuauugacaguuccaaaauuaaccuacuaagccuguuaaaaaccucugauaauauuaauaguuguugaacgggggaaaugacguuacuuguuggucagcugugcccuuugguuuuuaguagcuaaucccgagauuuauugguuagaaguuuugccucccugaaacugauuuauaaaccggaaaccuguguggaggggcgggggaggggaauggguguuacaaaauucuugguaguuuaaaaguaaaauuuuacaacacuuaaguuguuugguaauucuaauuuaugucuucauugucucucacuugggccguuguuaaaacucuucccuaacuggugguuagucuuucagucacuuaauacccuuccucuugaaauguuagaaacccuucuguugcuggagggaauuagguuuaaucuucgguuggcuuucggagccagccggagcuagccugucuuuucaugugccccacagggcuauugcuuuccuuccuucccacacuauccccgcugcgagaccacacggcagaacacaccgguucugacccagcugcucgagucuucucauccucacuuucccgccuguaaaucgaggguauguugugcgccuuacaagguuucuugaagcaaucaaaugaguaugagguuaggugugguugauuccugcccagagguaggaaggaggaaagaagaaaugacaguggaugugaugugaacaaauuucucaaacuaaacggcugcuugcaggaucuuucucaacauuuucagaauccugccguccuuccagccacagccuaccuucaucugcaguuagugaaaaaccagcccacagcagaaucuccucucucaauacaguuaugaaguauauguauauguguguguguauguauguauguguacauguuucugguuugguuugguuuuacuucuuuuuuguuuuuugguuuuuuuuuuucaagacagaguuucacuguacucucucucuggaacucacucuguaaccucagacucagagagauccaccugccucugccucuggagggcuggaauuaaagggguacaccaccacugcccaacuuacacccuuuguuuuuagcacauagucacauauuacuucaaccauacugugucuugccaaguagacuguaagcuuuggagccugaaaaggcuugggcuaagucccauucauauuuuaggccauccauauacuuguugagugauugauaaccaacuugggugugcuuuacccaaaaugacuuuaacuaacaucuuucuugaaagaucuccaccuuucccccagucccuguugggggauugagccuaagacauuguaauuauugguugucuuaguuggaauuucuauugcuaugaagagacaccaugaccacagcagcuuuucuaaaggaaaacauuugauugagacuguuuuauaguucagagguuuaguccauuuucacagcgggaagcaugauggcaugcaggcagagcuggugccggagaggaggcugagaguucuacaucuagauguacaggcagcacaaagauauggugacacugggccuggcuugagcaucugaaaccucaaaaguccacccaccauuacauacuuccuccagcaagaccacaccucccaguaaugcugcucccugugagccauuuucauucaagccaccacacugaguacuguuuagccaccaaacuacacugcuaacccuaaggaaagaccuuugagggcaguaggucgccaucccaacugaaguugauuaugaaagcucauaagaaaaacuuacuuguacaaacuguccuucaacaucuuccagaaagaauauuaauagugcuugaauuucuguuuaaaauuaugauaaaacuuauaggauuuaccuaauuuuauaauuuuuaauuucugacucauuagagaaaaauugaguucucaucuaguguuuaaaaaagaaauguuagcacuugaauccagcagguuguacauguguaugaucccagcaucugaagcagagacagaaggauaacuguaaguucaaagccagucugguauauguagcuaagcuagguggggcuauuuagggagaacauaucuuaaaggaagggggggggggaggggagauggcucagcaguuaagaucacuuggugcucucauagaggagccggcuugguucacagcauccucuuggcagcuaaccaucuguaacuccaguuugagauccuggagguccaaugccuucuccuggccugugaguacacuuggcacauacgugacggacugacagacauuuagguacaacacucaaaaaaauaaaaauaaaaacuuuuauuuauuuauuuuuggugggcacaccauguuugugugugugugucguccuggcuguucuggaacuugcucuguagaccaggcuggccucaaauucagagauccgcuuguuccuccuucccaagugcugagauuaaagaugaacaccaccaagcuuagcuuuaaaaagcgacuugagucugacuugucaguaaguccuuugaaugugaaacccugagcagauagauuugccaugucagguugauguuaccauauuagagcuugaugugagggucuugugaguugagacuucagcuuucucuacagaggaagggccuuuucacugacgugaugcuagcugagcuguucaacccgggguugggccuacaagagaggccucuccaaggaagcagagggguuuccauuucaguggcuccuuuagagggggaaagaggccuugaugauguaggauuucaacuuggauagcacaacuuugaauuuuucucacuacauuuuuaaaaaauauguggaugucgguuaguagauguaugccacagcaugccuguggagacuagaagauaacaugcuggaguuggcuuccccaagugagucccgggauuauaaucaugccaucaggugugguggaagacuggcugagccaucuugacagcccaaguguaaagcuuugcagagagcuaaaaaagagaagaccuguuacucccaauuguguguguguguguauguguggugugugugugucucugugugugugugugugagacuguuauuuaacccucccagcauggggcaauaucagacuguuaggcagucacuacacagcuaguguucccuagccggcacaccuugugugugaugagauagacacugcuaauaagaguccccuuuacguacuuguccucuucuucuuaggguagcucacaaacacaucaccccagcaaaagccugaccacuacccaccauguuagagaucaggaacaguacuucaggcuuuucucuauccuagcuuuugaggaaccagccuauuacauuuucuuuauaauuugcucuugaaaaagcuuguguacucuauuuuugcuuguguguguguguguguguguguguguguguguguguugcguuggguaugugcauaggugcuggcauacuacaguuugaauguggauguccaagagcaccuuugaggaguuggugcuucccuuccuucugcccugggaucaggggucagacucgggcggagagcgagcaccugcacucgcugagcuuacccugcuggucccagagacuguguccugauggcaggauggccuuauuaggcuugcuagauuauagaaaguuacuacccacuucauacaaaccuucauucugugagugaaaauagucuucuauggaaguaaggacaguuuguuucuauaauaaaauguuauaaaucuuuauucccaguuucucuauggccuuuguuagacauuugcuacugagucaagaggaauugcccaugagugguugugacaguuacacuucagccuguucauccuuaaagcuaccuuccugccucgccugcugacaagcagcugcucuccuuuagcuaacugcucgucucgucuguuuauccacucucauuuuuuuuguuugguuggauuuuuguuuguuuguuuugagacaagguuucucuuccuacagaucacacuggccuggaacucacagaaauccaccugccucugccuccugagugcugggauuacaggugugcaauagcaugcccagcuuaacuugucguuuauggagaaguaggacaccaacaauacaaagcacacuucacuuugauugaaccguuguccccuuugagcucuuguuaccuugucauuugcacgcugcuuccccucccaaauucccagaggcuuuguccugugagcaccugaagaugcacacuacucuacuccacuccccaguguggacuccugagagcgagacuggaaauucauguaagaguuagacggguaaauucauuugaagacgacaucuaagcaugaagaagccacuguucugugauaguguggggcagucuuguuuguaaagaugacuuuuccuuucucaccaggccuuucagcuuggaaacuagagcaaacacucucacucagucuguguuccuccuucccuuuugcccuugccaccugaaauuacuagcacauuguuaucuguuuaccuacuuuucugaaauugcccccuuaaaggacaccaaauaugguauugccaaauucagugguuucuuaagucaucauucuugacuuccucuuccaaaaggcucuuagcuucuguucuuuucuuuacugauuugcuuuccaacucugacuccaugcuugugugugugugcaugugugucuccuuuccuuuuuuuucuuuuuuuuuccccuuuuuuuuuuccuuuuuuuaacagguguugagcuccuacugugugggccaucauguucuaggcacuaggaauauaacaguggacaggagagauuaaagcuuggugccauggagagaaaugaucaguaauuucaaaaaguuaauucuacccagaaguggaaaugggcacuuaggagaccagcuccucagaagguugaaggaagauuuaauuaauuagacagggucucacugugcacaguuugagagcagccuagguaacuuagaccucauuaauuaguuaauuagguggggucucacuguaccgcccuagcugaccuggaacucacagagauccgccugccucugccuuccaagugcugggacuaaaggugugcaccaccaccgccacccagcuucucuguucuuauuuguaccuaagagaaagcccuuggcuagccgaaagucuuaggaaagaacauuccagauagguucaccaguacagaaucucugagacacgagauugcugagugugugagaaaagccaguggccuaagcagucuggcagacggacaacugcuaaguugguaagcagggacagaagucagguucauugggaagcaguaagcagugggaugaaacaaacacacaaugaaugugcucuaaccacucaauggcgggcggcacaaguuccuccauaccugccccaguguucuggauucuugaaugaaagacagacagauauaaacacaugugccgccuuauauuuaauaugucuuaaucagcccagugacuagguuacucgauaaugccuccccuccaauacuccugaauuauuacuaaagucuacauucugucuuugcuauacuagaucuaauuagggcggugugugugugcguaaacacacgcacuccuccaugacuauuacauguuuguugucuguguccugcacuucccccagcaugacaguucuguccuuccucuucucucaguccccuugccugugaaucuuaaaguccccuccucugucucccuacccagccauuggcugcuggcaacuuuauuuagcaaucgaaaucaacugagggaaagaacccucagcauuuuacaugagggauucucaugaaauuugagaacccaaauagcauaauacaagcauuaagccaaauccaugcuucccccuuuuuguccacuaaaaaggcccuuucuuucagauauacaaugaacaguuaaaacaguuaauauaaacuauaagguaugauauggacuaauaaccaucuagucuaucaauuugcgaacuuagguauauuacguuaacauuaucuuagucuauaauaauagcugaauuauguuuugauuuuuaacuuguauuaccaucugcaaaccaucuuuuuaaaaucuagaucuuuuuuuaguauuaaacuuaagugugauuuaugagauuauaacuugucuucaacccugccagaagucugagaaugauuuaaauauuaucugaauauauuugaagcacaaaaauauagcuuucgcugggcagugguggcacacgccuuuaaucccagcacuugggaggcagaggcaggcggauuucugaguucgaggccagccuggucuacaaagugaguuccaggacagacagggcuacacagagaaacccugucucaaaaaaacaaaccaaacaacaacaaaaacaaaaaacauagcuuucaaaacuuaaucaauuuauagagauagcugacuaccugaacaguugcccauuuaaaauguugaagcaucugucuucagccuucuggcccagaaccaucugacagaccuuaaaugaagcagcaacuauggaagacuagcuuacccuuucuuggcagagcuaagcugucgacuaucccacauccuguguccuuuccuggacaguacuuuuggucugucgaugaauaagggcaguucuuccccaguggcuaccuuguacagcuggagcagcucucugaggcgguuaugaugcucaguaucuucucuugauccaugaaggggguacugucaggagcagacaugccucuuagucaaaaauuuaauaauacauuuaauuuaacuauaaaugucauauuugguagacuuuugauauuuuugaagacuauauaaagcauaucugaacuguuaaacuuugacuauucuuagcuauuagaauuggaaacaccuuauaauuaaaucagaauauaauauaaccaugaguuuacuaucuggcucuuaacuuguguuaaucauuggaguuuucauuuuuaauuuuuauuacauuuauuuauuuacuguauggugaauacaugugaugacaauucuuuccuuuuaccaugcuggacucagguaacucaaguuacagguuuuguaauuugagccaucaucuugcugccucuggcuuagguuuuuuuguuuuguuuuguuuuguuuuuuaagauuuuggugccagauggaagauauuugggccuggugaacagauuaugaagaucaugugcacacaaaggcaaaaugccauacacauaaaauaaaaaauguaaaaaacgagaguuugaguggggcugaaaguguagaucagggguagagcauuaguacaagcaggaguucaauuuccagcucucaacagaaagaaaaaucaaagacaaacaaaaucccagcuuuucuagaacaggaucccauguagucaggcuguggagcuaauauuggcccugaauuucacauuuuuggccucuuauuuacacauuuaaaaacaauguuccuagacaaauaccucuuccacuuuuaaaaaaaaaauaagugauauuuuuuccuaaauaacauuguugauucuuuucugucuuuuuauguuaccuguaauaauaauuuugaaacuuccaggcaagaucuguauuucugcuagucuauuguccauucucauguguauuuccaauauauuuaaaauggacuuuuuuuucuacuacaucuuuuauuuaaccugccaaauuguauuauuccuauaaaaucuuguauuuaaccaguuauacaaaacccccuuaagcuacucauauuccucuaccuugcuuccagcuuucagauacuuguucuucaacaucaauaguaaguuuuuccugggaaccaagaauuucagauacugggucugugucagccacgugaugggacacgaagcccacgcaucucucgggcagggcggccuccugagcgcugcuaggaacacuuaaaaagaacugauccguaagacgagucuuaauuuaucuugauuuucuuucuuuuuucauuuugguugguuguuucaauacaguuucucuguuuaggucuggccauacuaaaacucacucuguacacuaggcuggccuugaaaucaaagauccaccugccucgaccucccuagugcuggaauuauagguguguaccauacugccuggcuuauccuuguuuuuuuuuuuuccaaggguucuauggaacaucagcuuuauauuggcuauuugaauucuaggggcuacuggaaugacuuaguggcucaguaauagaucacuugccuagagugucuggguuugauccucagaaacacaccuaaagugaaauauuugggagaacugggcuaaauggauguaaucagcuuucauuauuuagaucauugcaaacuauaauaggccaguacucacaaggacuugcccucuuaccaaaaagcaucuaaagggacuuugauuucuuuuauuuuuaauauuuauuuauuuauuauauguaaguacacuguagcugucuuagacacuccagaagaggcaucugauuucguuacaggugguugugagccaccaugugguugcugggauuugaacuccagaccuucggaagagcagucgggugcucuuacucacugagccaucucaccagccccaccauaauucauuuaagugaaaaauaaaaauuguacauucugcaugcuuaauauaaaccagauacuuuagaaggugaaauggugaaacaugcuauuuauaguucaaggaauuuaacuucuagagaauuauaaauauuaacauuuaaaaauaagauggcuacaucacuuucuuaaaugaagccaguaggcaucuuaguagcaugauauucuuuaauaaccauuuggagaauguuuuucuuuaaacaaaacuuugaaucacuacuguuguuucuuggaacuuaaauuuuuuuagagugacuccauauaauauauauuuugauuuuugauauaacauguaugaaaacauuuacuggggggcuagagagauggcucagcugguaagagcacugacugcucuucugaagguccugaguucaaaucccagcaaccacaugguggcucacaaccaucuguaaugaaaucugaugccuucuucuggugcgucugaagacagcuacaguguacuuacauauaauaauaaauaaaucuuaaaaauuaaaauuaauuguuaaaaacaaaaaaagaaaacguuuacuggucacucuucaauauuucucugcaacaaaaauaaaucuauaaauugaacuucagauuuucauuguucagcuauguaugugguacaggggaucaaaaaaccuagggccucuuguacacucuacuucugagccuauaccccuagcuuaaaaaaaaaaaguaagcuaauuaaagaaaauuaaggugauucauagcaaagaauaccugugcagaaucuagauuuaaaaaggggaggggggacucugaaaagaacagaggggggagagaugagaagguaaagagggugacuacuguggccagaguagcuuguagauacaggugacuaucugauaacccauuacuuuguacaaaugauguauacuaauuguugaauaagagcauagacaugugugagugucuaugugccacaucugccacaucuguuuuguaaguugcauuauaaugguuuaauauguaaugaacaacaauuuguuuguugucuguuugagacagguucuuggcuguccuggaucuccccuauauagaccagacuggaacccacaagagauccaccugccucugucccccaagugagauuaaagaccaccacacccaacugcauuauaaguuuuuauaaguaauuauuaagcaagaguccagguuuagcagaaaugccuuccuuaaucuuaaugaaacaggugaagcagccacuccuaccuuguccauaacaauggacaagcauuucuugucauuagaaugaagaagaguucucaguuuuuauccuguuuuuauaaauguaaguccuuagaaaucuugguucaugugaaggaaaggaagacagcaauauuucguaugaaaccuuguuguucaucccagaucacacuguuacagcaucaguaaauagcaguuuguacugcucucuacacacagugcacuuccauuccugcuccaguugguaccagcacauacaucuguccuacguagggucuggagauugcacuggggaccagccucacccagcaagcaccuuuaccacugugucgucuugccaacccugcaauauuacuuuuaaaaauguaugugcaccacaugugugccugaugcuccagaaggucagaaggucagagagagugucagaugcucuaggacuagagucacagacauugugagccaccauggggugcuggggagaaggccagguccccugcaaaagcagcgcaugcucuucaccgagccguccgucuccccagccccuggaauaguaguacuuuuaaaugaaggcaaucuugucuuuuucuguuuucauguguguguagcauauguguauguacagaccccaaaucugacauuagauaccuuucugggacacgugugugugugugugugugugugugugugugguugcuggcaauccaaacucagcucuucaugucugcaccaaaagcaggguacugauagucccaucucccagccccuuuucauuucuaacaugaagaaccuagaggauauuauucuaaaugaaacaaaguagucacaaaaaagacaaacacuacauaauuccauuuguacgagauacuugagucagacugagaaacaaaggagaagguuggcuccuggggucugggggaaugugcaacagagaguacaguggauagcaagucucaggcuuugugguugauuuguucugaggguugagggcugaacacagagccuugucaugcuaagcagaugcuccaccaugggacaccuacauccucuuaggguuuccuuucugaaagauaaaggcauucuagugauguguuuaaacaacaguguguguggguguguguuucaagugccccccucccccacaaggcuuuuuacauggguuuugggaauggaacucaugaucaggcuugcauggcuaacacuuuuccccacugagccauccccugcucugaauguguguuugaucagaagacaaguuauuuuacgaaccauauauccuuacguuuuuaauucuguguguguguagauggcggccugucaguaccucuuccaccuuuuuuguuuuguuuuguuuuguuuuguuuguuuuucgagauaggguuucucuguguagcccuggcuguccuggaacucacucuguagaccaggcuggcuucgaacucagaaauccgccugccucugccucccaagugcugggacuaaacgcaugcgccaccacgcccagcuccaccuaaggcaggguuuaucaaucaaauaucaaucaaauuccgaguuugcugauauggcuagucuagcuaaccaguuugcucugaggcgcccgucugucucugaagcaggaauuauuauaggcaggcucccacccccaccuggcauuuauauaggauccauggaauccaauuucuaguccucagaggaaccacugagccaucgguucuuuugauuuguucccccaaccccuguuuugguagugcuggcugugcuggaacucacucugaagaccaagcuugccuugaacucagaguucacagagccugccucugccaccacugccugaccaaggacauugucauuucaaaggcaauguaaagaaaggugcccaugauuuucuuccuauauaugaaacaaggaaagucuuuucucucuuauuuaauguucacuucagucucaaauaguagacauuauuuggcgauuauauguaaguaaacugagacuuaacagcaggcuaauuggacagcguugccagcaaacugguagaaccagaauucaaaguaaaggcucuuuacccuuccacuggauuacuuaguuucugcagguggaucauaggugaaagcacucuaaaaauuagaaaguaagcugcugguuauuauuuuauuuaguaaagaccaaugguuuucauugaagacuggcggagagccagugcagugcaauagcacuuugcaacucuucaccuccucgcuuacucuuacauccccacccccucaguuuccuuucuuucuuucuuugccuuuuagagucucauguagccuacuacacugcccccuaacuaugugguugaggcuggccuugaacuccuauccuuaugccuuuauuucccaaguucugaaacuauagguauucaccaucaguccugggauuuauuucuuacuguugcuaaugagcuucagugauggguauguccaaaccuuuagcugugugagagugugcucaguucagggcauuuacagaucuacauaacacccuugccaugccucacagacggugggaugcacucacucccucauccuguccagcaguacacuuuuuuuuuuuuuuuuuuuuuuuuugcuacuaagaugcuguuugaaagcagagagaauacauauugugcuuucauuagacaagaaguuucaaaauucagagagcagagucucagaaaaucuuacaguauuaaauguauauguggauuauacacacguaauucuuccagacagcaaaaauggguagcagaaggaugugggcagugcagggccgagcaacgcuggcuuuacauugcugucagcgguucugagacccaggggcugugaaggcugugcccuuuuuucuuauuuguuucuucuuuuucuuggucuugccuuuucuggggauugaacccagggcacuaugcucgugaggcagacacuguucuacugugcuguguuguagccucagcuggguuuuguuucuggaaacaagaucuugcugugcccagcuagaauucaacuuguucuccugcuuuccucccagauccuguaccugcucuagcuacagaagcuuauaucuuaucuagauuaaccagguaaauggaaauuuacauuuacuagggucucagcaggaauguccuauuccaucagacacaacugaaagagaauuucagagugugaagcaagaggagagaauugauugugcugcuccaucaggguccuguguuaucgccacccagcucaacauuagggauccaggucccuggcucagcacuuuccuuuagagagggagacugaagugagacugaaggaagcacacugaagucuaacaggcagagaucagcugagcacagugaaccuagagcccgggacauggggaugggguaaggaggaugugcauaggcucuguggagcaggugaaugcauccggagacagagugaacugacauacuuccgaggcagccuguacucacagugacuucggaaccuaaccccugcuguucuugaggagagaugaacagcucaggccucucguucccaaauggccuuuugccauuuauuguuuaagauggggucuugcuuuguaguuucgguuagcugugugacuccugccucuaugcugagagagcuaagaugacucugugccuccaagccuggguauugaggguuuuuuuuuuuccccaucuguuuguuuuguauuugaaagaaagucucacuaucaccuagcauagucuuaagcucccagauucaagcagccaucccuccucagccuuuuaaguagcaagcagcucggcacuguaugguacuuuuugguuuuguauaguguuggagauugaaaccagggcuuugaugugcuaagcaaagacuccagugagcugcaucaccagcccuguaaccuauguuuugaagcaaaucccaacaauaucagaagugaggccugggggcaggagaaguggcucagcaguuuagcugcucuucaaaggauccaaguucaauucccagcaaccacaugguucuucacaacuacuuuuccagauccaugugaucugaugcccucuucuggccccuaugggacugcaugcuugugaugcacagacauacauacaggcaaacauucauacucaggguguggugcaugccuuuaaucugugaguuccaggccagccugguauacaaacugaguuccaggacagccagggagggcuccauuacauagagaaaucuugucuugaaaaauaaaauuaaauaaauaaauaaaguaaauaagguugaaaagagaaucagacaugguacagaagcaggaggauuaaggccagccugggcuauaaagcaagacuguguaucaaaaacaaaacaaaagaacauguacuguucuuagaaccuggguuugguuuguagcucccauaccaggcagcucacaagcaccuaugacuccagcuucaggcaauccaacauauucauucauguucgcacauaaauagaaauaaaaaauucuuaaaaauaaaaagaggaaaauccaaggggaaaaaguuggcaaggaaaaaguggauaaggauauaucgccaaguuugacaaccugaguucaguuuccagggcccacauggugggaaagagcuauuggacucucccccaaguuguccacacacaugccuugcuacaugcacacacaaucccacaaacacauaaacaaauguaaaaaaacaauuuuuuuaaggaagaaaaggaggcaggcauggugguacauacuuuuuaauuccaguacccagaaggcagaggcagaagcagaggcagauggaucucuugaguuugaggagucuggucuacagagcaaguuccaguacaaccagggcuacacagagaaacccuaucucaaaaaacuggggcauugggggauggguggguaggugggugggugggugguggaauuuggaggaccacugcagacgucccaauaucagaauaauagaaauuacaguaggaaaauaaagugggaaauuaccuauauaacuuaauuuugacagcugcagggaaugaucugucauuaaagggugugccugugcccagacuuagguuaguaaaauagagccaugucagucaugccaucucaaaguucuggaaagagggucccuugugacccacaccagcaguagaaaacaggaagacagcugaacagagcuucagaguccugaggggaucuagggcaaugguaagugaggaaguaugagcugggcaugugggaggagcugaauuugcuucccuagcacacaguccaugcugggugagcgugggggcucacuguggagcagagacagaugggcgagggcacuuagcuggacuugucagaguacugaagucuggagucaccugagagacccuggcucaguggauaagguggucagugauugagaaagauaccugaauucaaccucaggccucuacacacacacacacacacacacaccccacccccacaugcugcaugugugugggucagaaggcacuuccaggguucuggggaauaaccucagguuguuaggcuuggaagcaggcauauuuacucacugaaucaucuagcugccccucccucgguuuuaaauaagagcuuuagugugauaguagucacaugcugccucauucucccauuuuagauaccuaguucagugggcaugcuagucuauucauagaguugagcaguuguacgucacuuacagaacguguuccuaguaagaaaugcuacaucuccuucagcucuuccucucuucuacagccccccuccuccuccuccuccuuccuuccuucuccuuucagucccuggcaaccacucagucugucuaccuuucaaacugaguuugagaaggaauuagcucuccaugcucacccuuuaugccuccucaccugguaacuucugcuuagggaauuuaaccagggacccucuaauugcuggucugcugcucauguacagugcuuaccuuucuguuguauuuggccugccuuucuccuuuaugcucuguuuucuucuguccucuugcuugcuucccuuuuccugagugauaaggugugcuauuaauguuccagccauguccugcuaaugucucucuccacagcacacagucaguaucacucacuguuccuagauaugacgugggaaucccacagccauuucuucaugggugagaugaaacucaccuuguuccucaucgaggaggaagaggaagaagaugauaaaaaggcauucgaacuugcuagaaagcccuacuucuuuuaaguaaacuaaaccuuccaaguugucuucagccuaacuaaaauaguuccuuccccacucauaaggccuucucaucuuucagacauuaguuacacuacuucaggaucugagaaugugucucuguugguugagucacccucagcuaaaagaacuucaaggccagccugggcuacaugagcuaguuuaaaagagaaaggggagagacugcuggacagaguggccuuuccauacuacuuuuguaguuuccucuuaaucuaaaaugaauucacaguaaacacuuaaggacaauggaggcaggcaguaccaguguacuugauaaaccuguucucuuccuaaaagaaaacaaugugggcuggagagauggcucaguaguuaagagcacugacugcucuugcagagguccugaguucaauucccagcaaccacaugguggcucacaaccaucuguaaugggauuggaugccuucuggugugucugaagauagcuacagcguacucacauacaugaaacaaauaaaucuuuuuuaaaaaagaaaagaaaagaaugcaaugugcauuugcagcauggcgacagucccagccuucgggauggcaaggcaggacagucaaaaguucaagacccgacccacaauaacacuccaaaaaguuuuuaggcaccaaacuguaaagucggcuggagggaccuugccauccucagaaugucucuggcaagugggagggaccuccagaggccucauguacucccugugcugggcuguuugcacccuaaugggcaacuauuuuaaacuacaggcaaaugacauaaaagagguaaaauccuaacaacaggguauguuagaggcaguucuguuguauuucuuuuucguguuguuuguuuugagggauucuguggguagcccagguuguccuggaacuuucucuguagaacuaacucaagucuggccucgaacucagagauaaugccugccucuaccuccugaguauugggauuaaaaagauguacagcaguacugccuagcuccuuaugucucucucccucucucucucucucucucucucucucucucucucucucucucucucucucucucucucuuuguuuuuuugauuuugagauaggguuucucuguauagcccuggcuguccuggaccucacuuuguagaccaggcugaccucgaacucaggaauccgccugccucugccucccgagugcugggauuaaaggcuuauguaucucuuaaaaaagaacugcugugggccugugugggcuuguuuuucuacugauagcaccuggagggcucuuccccauucuuugcugagggaacauguguaugaucugaaacgcugaugcacgccauuuucccacugggauuucaucugcaagauugggcugaaggcucuaaagcagauuccaguauuuacaaggauccuucccaagauagccaaacacugaaagcuguagaaaacaugagauuuacugaauuuuacuggcuguaacaugggaucaaugggucucauguccuagggguguuugaauauucagugggaucccagauuaagaaacucagacaggggcuggagagauggcucagugguuaagagacugacugcucuuccagagguccugaguucaauucccagcaauggcucacuaccaucuguaaugggauuggaugcccuuuucuggugugucugaagacagugacagaguggcaagguacacuuuguaaauaaugaauuuuuccaacaaaaacagccgugaagccucugaacguaucuaugcagaauagagcugugagggaaggaagcugaauucauuaggaguucuagcgagguguggguauuugcuacaacccuagcauuuuguaggcuaagaaaggaggauuaugagucuaggucagucugaauauacaaugaguuguaguaggggaaagagccaaacaugaggcuuucuuuuuguuuuauccugugcucuggaggaguuccagggagccacagccuuggugcagcuaugguaugacugaggagaaaaaacucaaggacagcagagccaaagcuuggugcugugaagacccaagagcaaccaggagucacagaagggcucgagaaaaggagugaucacacauuugcuagucaccaucauuauuugacccuggagucaaauauggguaggagccaugguacagcaacacugguucuagaaaucauucaaauaguucaaagagaagccccugguguuaguggauacagcaaguagguggggugaagaaaaacuuugggguauaaauauagcucagugguaagugcuugccugguguggagaguccuguugacuccccaccaacauuaacaacaagaagaaaaagagcuagguauagugguauacucuuuuaaucccagcacuugggaggcagaggcaggugaagcucugacuucuaggcaguacagcuuacacaguaaguaaagacccuuccugucuuagauggguggguggguggguggguggacuggugguugaacugguagauaaaagagaaaauuaaggagggguagguaaaagguaaagggggaugguggagacugcuuugauauaggggcaggggucucuggcuucuguuuguggaacuggcuggcuaguacuaacauccucuaaaauaggaauaaggaguggggacacuaccuagggcuagauugcaucugaaggcaccugugugcccuagggcaggugugcagaugguuauggagggaagcaggagucugcagaggugggugagcacaggauacagcacauuccauccccugugugcuccucacugucccaggacgggguguaugugggaguuugcucuuauaugcuugguacucauucacaugaagugaacaaaacugggggugcagacgaugggguaugacgguugagucacucugaaaggagaagggagaaaagucgcucugggcaaagagaggaaugagugccggagccccgaggcaggaaugagccugcacauuugcagaccugcaagguucauggggugcugugggagcaggagaggugguggagggguacccugugggagcaggagaggugguggagggguacccugugggagcaggagagguggugagggguacgcuguaggagcaggagcaggagaggugguagagaggcagcugcuaacuuagcauuccagccaguggcauuggacuuguucugggugagguguucagcccuuggagcaugaggaagagggaggagaugugaucuaggacauguguaguaggacagaggagaggacuacacugcuucauccgaggacagggaucagaagagagagcucggaggccaaaaagaaggaacugggcagguggugguaguggcacaugccuuuaauccuagagaguuccagaacagcuagggcuacacagagacacagagaaaccuuaucuuaaaaagaggaagaggagggaagcaggagucugcagaggugggugagcaccaggauacagcacauuccauccccugugugcuccucacugucccaggacggggugggagagcagcaggggugggcgagcugaugcuaaaacaagaccguggacaggaaugugaggcacuuugaagagaggcugauacauagacucauuagcuggcauaugguguggggcacagaugacagagaaacggaaggacucaaagugugguccacauccagaguaggacggauggaagucaccuuauagaggaccugagggacgcagugggugguauguggccggggaggaaggaggaacagcaacaagaagaaaugguggccacuaauuaggggauugcugacaucuuggccagguacagugugugugcacuuguaaucucagaacucaagagcuaacauagccagauguauaaccagugagacccuagaacaaaucccaggcaggugggaacagcgauuuuaagaguguugcucuuccugagaaccuggguucaguucccagcacuuacaugauaacauauaagccucuguaacucuagcuuuaguggacuagacacccucuucuggccucugugagcaccaggcacaaacauagugcuuuuagaugcaugcacauaaaauaaaagugaucuuuaaaaucuuaguaguaguuuggaagagaccuuguaaagaaugauggggguguugcccacaagccaggaugcugauuuuugucuguaagguaugaaugacuauagcuucagagcugugcugauauccuggagaccucccccuagaguugaauuugguggguagcaucaagaaucucuggccuuccuguaggagagcuggcccacguggggugggaaucaggacuaaggaugccauuauagagacacuagauauucugcggaccacagcuacccaauuacaucaucccauggaacaguaccccauggaacuagaucauucuagaauucucuguaucucuaagcucagcauaugcucauauagauggagucugggcuuguauuacuguacaauauucacauaacuuuacucuaguagugguggggacugaacauacacuaucacagauuguaggugagcaccuuguuucuguguccuaucuccauccugauauuauucaaccuguucagauugucuucucaucuuccuuguggaugucuggagacuaggcacccaggcuucccccacuuuuccuuccccugcagggauuuugcacauacugagcacuccugcaaguguccagugcuugcgaaucagccagggcuaccacauccuacaguaccccaccccagccuacaucauuccagugaaaucuuugccuaguugaggauguggccaagcacuucuccuggcugcagcacuguguuagaaaagugagcuguucuuuuggaacuugucugcagcuguuugcauguggcuacucuagagggauucuguucuaaucugaggcagcugacuggcuuauaaaugacuugacaccuuugguguccaccuucacugaaaagaugggaaagugaccagccagaugucacuuggagcaaaagaugaugauaggaaagauagaaagagcugcaugugguugugaggcaccaugugugugcuguggauugaacccagguccucuagaauagcagccucucuuaugcaaugagccauuucuccagcccccaagggcuuguucuuaaauuggauucuuggaucagauuaaguugcuuacucugccccacgguucccuuucuuagacaaacuauguagccauauguggauuuaaaggacugccagcugguagggguagaacucugagccaucagcuuuaauaaucaagaaaauccucaugaggggcuagagugauggcucagcaguggagaguggacacugcucuucaaggacucagguucuauucccagcacucacauggaagcucaaaacugacuagaggggcuggagagauggcucagcaguuaagagcacugacugaucuuucagaauucaaaucccagcaaccacaugguagcucacaaccauccguaaugagaucugaugcccucuucggggugucugaagacagcuacaguguacuuacauaaaauaaauaaauaaauuuaaaaacaaaacaaagcaaaacugacuagaacucuggucccaggggaauccagugcccucuuguguccuccauaggcacugcacacaugugacacauagacaagcaagcaggccaaacacccaaacaauuaaaauggauaaaaggaaaaugcugauaaggugggaaagaagguuggcagcaguggaaacugagaggugaaggaaacuccuagugaccagaucacaggcugcugcuaggacacaaauucagauuagagaaugccgcacugcuuccaaaucaguagcccuucccugcagccagauucaugagcaugggauucugcacugcucugacuccugaaaaucgaaaacuaaaacuguuaugaggaacacuuucuuuguuaaauaaaugaagagucuuaagggacuuaaagaugguucagagguuaagaccacuggcugcucuuccauucuuccaaagguccagaguucaguucccagcaaccacaugguggcucacaaccaucuguaauggaaucuggugugcaggcauacauucagacagaacacuguauacauaaguaacuaaaucuuaaaagaagaagagggucucacuccauagucgagguuggcuuugaacucuaaagacuuaacucagccuacuaaguacugggaucacaagcauauaccacacacagcaccaggcugggacauuuuugauaucacacuucaugugcucagaaauaguaggagauggauucaguacugggggugagggguaaggauaagauauaacuuaauaaaugugagcauagggaaggagguguuuagagcugaagcccagggcugggagggagggagccacacucugccaguucucaucaaggaauucccacccccaacucuuagggagcuuauucuauggcaugcaugggacauuuguuugccuuauucuauagcaauguccaguuugcucugugcucucaggagacuggaaggccauuaagugcaaugacugacuuauuugccuguauaguccccacagcacuuguaaacuggcacaagaaaacuuuuuuuuuucuuuugguuucucaagacaggguuucucuguguagcccuggcuguccuggaacucacucuguagaccgggcuggccucgaacucagaaauccaccugccucugccucccgagugcugggauuaaaggcgugcgccaccaccacccggcacaaguaaacucuuaauaaggcuagcaaagugaagcuagucacaaagaaaaugagggugccagagcagacaugauggaguccagugacagacuuucuaggaguggcaguguuuguaagguugcuaauggggcaacuggugagauggcucagugaccccacacacacacacacacacacacacacacacacacuguggucuguaugaauaccccucacacacacacacacacuguggucuguaugcauacccccacacacacacaaaauaaguagauguuaaguggaacaagagcugaaaaauacaaccagcucauguggugcgugcagaagcucauguggugcgugcccuguggagggagcguguggcuuugauaaggauaagaaaugggcagguagguggacauaggauuacuguggccuccauugccacuaccugaggaagaaaaacuacagucagcauuccugucuuagucacuguucucuugcugugaggagacaccaugaccaaggcaaaagaaagcguucagaggguuagucuaggaccgucaagggaagugauaugguggcaggcauggugcugcacaguacccaagaguucacauacgauccacagguuucacguagagaaagagcaagacuguccccagugugggcuuuugaaacugcacaggacacccccagugacuuaacuccuccacugaggcuccuacuccuccccaaacaguuccacugacugacuaauauauaagcauaagggggcccuucucauucaagcuagcccggcuccugugguuggaaguuauaggauccauaguaaaucagccgaagcacaaggaaaaauguauugguuuaggacuggaaagucggguugggggcagaggggcuggagguggcagcugaggacauuggcaggucuuggguaucacaagauacaggauuccuguggugaccuaaugcacagcagccaucaucaagcuuguguccugccacgcccugugcaaugcucaccuucccauagcaauucagaugucuaguucugacuggccaggccagaccuagugauagaggcagugcuacaaggggaagcagagggcagggaggugugagggagcaaucaagguccugcuugagucacuguugggagcaaagggaccuaagacaaggcacugcuccuaagucuguguuccaauguuuuucagcaucuucaugauacagugaagaggagucuugacagugcugccuccccucagaauggcgaucaaccaaauggcuacggagacuuguuuccugggcauaagaagacacgccgggaggccccucugggggucagugugucugccaaugggcuuccuccugccucgccccugggccagcccgacaagccuucagggggagacacccugcagaccgcugggaagcacucucuggggcucgaucccaucaacaagaagugucuggcagacucaggcauccaccugaauggaggcagcaacuccagugagcccuuuccucuaagccugaguaaagaacucaagcaggagccaguggacgaccugccgugcaugaucgcgggcgcuggaggcuccguagcucagagcaaccucaugccggaccucaaccuuaaugagcaggaguggaaggagcucaucgaggagcucaacaggucagugcccgacgaagacaugaaggaccuguuuacggaggacuuugaggagaagaaggauccagagccuccuggcucugccacacaaaccccccuggcccaggacauuaauauuaagacugaguucucuccagcagcuuuugagcaggagcaguuagguucuccacaaguaagggcugggucugcaggccagaccuuccuaggagccucaucugccccugugggcacagauucuccaagccuugggagcucucagacucuguuucacacaacuagucaaccugggguggauaauuccaguccaaaccugaugccggcaucagcccaggcucaaagugcacaaagagcccucacgagugugguauuaccuagccagggcccaggcggggccucggagcuguccucugcucaccagcuccagcagauagcugccaagcagaagcgcgagcagauguugcagaauccccagcaagcugccccagcacccggcccaggccagcuggccacguggcagcaggcagggcccucccacagucccuuagauguuccuuaucccauggagaagccugccagcccuucuggcuacaagcaagacuuuaccaacucaaaacugcucaugaugcccggugugaacaagaguucuccucggccaggaggccccuaccuccaaccuagccacuccaaccugcugagucaccagucaccaaguaacuugaaucagaaccccgugaauaaccaagggucugugcuagacuauggcaauacaaagccccuuucucauuacaaagcagacuguggccaaggugguccugggucuggccagaacaaaccagcuuugauggcauaucuuccccagcagcugccccaucugaguaacgagcagaacuccuuguuucugaugaaaccaaagucaggaaacaugcccuuccggucauugguuccaccuggccaggugaguaggcccuucacuugccaucacucagcuacgggcacuagugaaugcacauacugaacuagaaucagcaugcacgagacagugguagcggcugcugucauccuuugaaguggaaaacguaaaaaacagggcaaggcugguguucguguuuugaggcacgguucauuuauccuuggcuggcuguggagccacgcugcucuugagccugauuccccgcgccucugccucccaagaguugagauuacagaugacuggaauugauccuuaauaaaaauagaguaaaauuccuuaauguagcaaggcagugguggugagaccuuuaaucccagcacuugggaggcagaaguagaggaucuuuugcaauuugugaccagccuggucuacaaagcaaguuccaggacagccagggcuacauggagaaaccuugucuagaaagaaaaaaauuccuuaguauaaauuagucuuuaacuacauaaacauuugagaaaucaccuaauuuaguuuagucgucucuugcaugccaaacaacuacauaaguccuugccaaaaaauaaauaaaauaaggggcuggagagguggcucagccauuaagacuggcuguuuuagaaguccugaguucaguucccagcaaccauaugguagcucacaaccaucuguaauggaaccugauucucucuucugguguguaugaagacagagcacucauauaauuaaauaaauaaauccuucucguguguguauguguguguguguguguuuuagauagucaaauagccuggcauggcagcacauaccuuaaauccugcauucucugaggaggcagaggcagggggaaucucugaguucaagaccagccuugucuauauaaugagacccuguuacaaaacaacaaaccaguugugguucacaguaaucccagcacagggaaguugaggcaagauugccacaaguuugaggccagccugggcuacagugugaggccuugcuuguuuuguuuuggagaaaagaaacgagggggaggggaugaauguauuaaguuccauggcuuuaagcaugaacucaagaaaggcaggguacagagcuggugggccaugugcucagaacuugcuccugaaacaggagcccggcagcucacuggccagccugucuaacuacacugagcagcucuagacucacgagauccucucacaaaaugaggugaaacaaugaagaaagucacuugaugcugaccacuggugcacaaagaaacaccaaauaaaauuugaaaucuaaacacuauaaaguaucugugucuucccagaaaaauacgcauagacuagugaacauaaaaacgauuucaugcucucugggccagccauaaggcaagucugcauucuuaacaacauagcauuauuuugcuuuuguuuuguuugguuggaggcuaggauauuuguaggguauuagugguuuuuuggcuuuuuuuuuuuuuuuuuuuuuucuucgagauaggguuucucuguguagcccuggcuguccuggaacucacuuuguagaccagguggccucgaacucagaaaucugccugccucugccucccaagugcugggaucaaaggcgugugccaccacugccuggcuuguuuuuuggcuuuuaaaaaauaauuuauuuuuauguacauugguguuuugccuacauaagggugucaaagguuggcguuacagacaguugugagcugccaugugggugcugggaauugaaccuggcuccucuggaagagcagucagucucuuaaccacugagccauuucuccagcccuauuguuugucuuuaaugaggcuuuuuauagguugguugguuuggaguguuguuugcuauuuuaaguuagggucucauguaucccugacugaucuggaacgcacagaguuccacuugccucugccucccaagugcuaaaacuuaaagaugccuccacacacaugagggacauuucauguccaaacuauaaaaucagggaagcagaggcuuggaguuacaaaagagaacaagacuaucacugggugccgcuuaucuggccugaucaggguuggauccauacuaucugacuuguaucccuucaucuuuguugacaggagcagaacccuuccagugucccuguagcugccccagcugccagugugggaacccagccuacugugucuguggccagcacucacaacagcucgccauaccucagcagccagcagcaggcagcugugaugaagcagcaccagcugcuccuggaccagcagaagcagagggagcagcagcagcagcagcugcagcagcagcaguuccugcagaggcagcaccuccuggcugagcagguaacaggcaccauuucagcuuguuugcacucaaugucagugucguguccuuuaaaacaauaaaaacaggugaagugcuaaagugcuggucagccuauggccugcaugcaaucccugaaucucacauacacgugaagagugagagucuacagcacaccguggcacacacaucucaagagcaagcauucacgcacacauucacgcgugaugauagguuguuugcuuguuuguuuguuuaagaaguuaggaccaguaggcuagaggucuguucccagcacccccacaucaggugguucacaacugccuauaacuccaguuccaggaauucaaccaccauaucucaccucuguggacacgucuguacaugugguacacauaaacccacacaaacaaauauguuuuuaagaauaugccagccaugguggugcacaccuuuaaucccagcacuugaagguuagaggcaggucaaucucugaguuugaggccagccugagcuacauggugagacacuauaucaaacaacaacaacaaaaccuuuaauauucaaucuuaaagaaggggcuggagagauggcucagugguuaagagcacugacugcucuuccagagguccugaauucuauuccaagcaaccacaugguggcucacaaccaucuguaaugggaucagaugcccucuucuggugugucugaagagagcuuauauacauaaaauaaauaauucuuuauaaauaaaucuuuuaaaaaaacauuuauuuuuauauguaaguacacuguagcuaucuucagacacaccagaagaaggugucagaucucauuacagaugguugugagccgccaugugggugcugggauuugaacucaggaccucuggaagagcagucagcacucuuaaccgcugagccaucucuccaggcccuauaaauaaaucuuaaagaaaaaaaaaaggcuaaugaaguagcucaguggguagaaguccuuguaugcagugugaugaccuaagugugacccagagucccacaagguggcaggagagggcugacuccagcaagcugcucucugaacuucacaccauggcacacauccauacacacacaaauaaauaaaaauggcauaaaguagagcagcccuugaaguccugcgaucacgaugcacauuuuccuacuggguugccaggcauagugcagaccccaggcaaucaugagagccuuugagagguugaaccaugucuucuaauuaagacgggagccagcugggcauaggagcccucgccuguaauccuagcugccaggaagcugaugcaggagaaucacccucauguuuagcuacacagugaguucgaggccagucugggcuacagagcgaugugguaucucaaagggagggaagaggccagggagggacucaaaagucggagacccugaguucauaacucugggacccguguaaagcaggguccaagucuguaacccuaaguggaaaugggaagcggggacagaugcccuugaugcaagccuggcuucaguaaugaacaaaagaaaccccgugacagcacgaggaagaaagcaggacccacaccaaagcccucugacacgccauggcgaugcuuacccacguaacaaacagagaauacuguggacccgacucuagagaccacacuugcugagguugcuuacuaccucagguccuuauuauguuuuguuuuguuuuucuagacaggguuucucuguguagcccuggcuguccuggaacucacucuguagaccagggugguuucaaacauagagauaugccugcuucugcuucccgagugcugggauuaaaggugugcaauaccaccaccaccacgcccgccaucuuuaaacuagcugcuuauuaggauauauucauuaccacauaugguuugcuuagccaauagacuucauugauguccauuguaacuguugugcagaguugugcaguuaccaccagagcccaugcuuaucgccccaaacacugcacccgugagcagucccuugccuucccugcacucacgggcgccugugagcaagugacaggccugcuggugccccuugugagugacacacuugcuuguacaccuugcguuucuccucauugguuuugacuucagacuuccauugaguuuuccuguuuguuucuguucuuggcacuuuguaggagaaacaacaguuucagcgucaucugacccgcccacccccccaguaccaagacccaacacaaagcaccuucccacaacagguuggacaguucacaggugaggagagguggaggaggcugggggaggcaggcuggggaguggagcucaugguguacgguccugauggaauugacuugcucacagaagcucugcuuaggaagggagggcuagauuuucaguuucuuuguggcacaagaaggucuccaggguuaacuaugaggauacucaguuaaacauccaucuggagcagaauuauuacuguuagaggcaucuuauguguaagccuuuguuuuguuuuguugcuagacaggauuuuucuauguaauagccuuggcuguccugaaacucaucuguagaccaggcuggccucgaauucugccucugccuccugagugcugggauaaaaggcgugugccacccccacgaccuggcuuauguguaaaucuuaauuaaaauaguucuuuguauccuuaggugaaccccacagcaagcuggguuugguggugcuugccuguaauccuagcacuugggaaguggaggcuggaaggucaaguucaaugucaccuucagcuucuuagugaaucaaagacucuugucuuuaaaagaaaaccaacauuuccagauggaaagauguauucuagugcacucuggugucacaaagaagggaggcaacugagccucaacgucaccucugagcuauagagauugcaagucacauggcagguguaugcuggccuugccuuccuuaguuaacguucacugugaagugucauagaaacugaccacagccaggaaagagucuaggugcagucuggugugcuggcuaggaauauggaguuggaagucuauuggagccacuggagcaugugccuggccuggguucucaacuccuuccaugccacacugauguauaugggcuguuagcacagugaagugguccuuuucagcucuccccuuuucgucacaacuguuauuuaaguuauuuuuauuaagucucccuuugauggguguuaugcacaugagauauaagugccuaugggggcacauuuguguaugccucuguguguauguguauuacaugugugugucugcaugggugcacucacaugugcuucuucugugcuacuggcgacuggagucaaggccuugugcgugcuaagaaagaguucugccuacugagcuucucccucagccccacauucaguucucaacacuuccccaaauggcaggcacaaugccuucagagucgugcauuccuaugaccugcugcucaagcugugaccuugucacaccaugugauggcguuggcuuccacagacagauucugggguauuggucuugaaaucccuagucccagcugagaaaacuuuguuggcuacuugauaaauaaaugaaugagacagcuggcuuucgccuguggaucucccuccaucugucuuugaguucuguccugucccugugcccgugacaugugagggcucugacuuucaugcccaugacaugugagggcucugacuuugaugcccguggaagaggagcucagcuugggccucagagacaguugaccaugacagucaggaaugccaacaugggcuggcaagauaguucaacaggucaagucugauguccugaaugugaucccuaagucccaccugguguggaagggagcuguaugccuaguuuaugacauuugggaagagggagaugcucaauugagaguaggcaaaccuguggggcauuucuuaacuagagauuaaugugggagggcccagcccaugugggugcugcuaccccuggucugguuggugguccugggaguaagagcugagcaagccgugguaaacaggcuaguaggcagcauccccguauggccucugcuuuagucccugcgucuggguguggugguguauaccuuuaauacuagcacuugggaggcagaggcaggcgauuucugugagcuugaagccacccuggucuacacagugagcugcaggacagcuagaguuacauagcgagaccccaucucagguuuggucaugguguuuaucacagcaguagaaacucuuuuaacuaagacaggaacuaaccccugccuguuguccuccuacucccucacgcuuguggcacauaugcaccugcaccaauaugcacacacaaacauaaaaaugaaugcugauuugacggcuagaacuuucuuucuucuaggaccuucugcugcugugccugggaugaacaacuuggguccguccaacuccagcuguccucgaguguucccucagccugggacucugauguccaugggcccuggacaugccccugucuccucucuccccuccagcucaggccagcaggaccguggaguggcccaguuuacugggucccagaguuugccucagaacagccuuuauggcauggcaucuggccuagcccagauaguugcccagcccccaccacaggcuaccagcacacaugcccacauuccacggcagaccaacgugggccagaacgccuccaccucggcugcauauggacagaacucucuggggagugccagucuuucccagcagcacaguaagggaacccugccuccugguuuaacaaagccacaagucccaagggugucagcagccaugggaagccagaaugccucguggcagcaucagggaaugccaaaccugagcagccagacgucugggaacagcagugugaaccccuucacugcagcucccaguuuccacauacagcaagcccaccugaaacuagcuggccagcaguucucccaagccaugcccagcaggcccauggcgccucugaguucagcaggugcagcagggcccaugcugcccccagugagugcacagcagaggaacagugccccugcaucugcaccuccccaagcagccccgcagcagggcuugccuggcuuaaguccuucggggcccgagcugggggccuucggccagagccccaccucccagaugagcggccggccagggcuacacugugcgcaggcuuacccugugaggaccaugggccaagagcugcccuuugccuacagcgggcagccagguagcaguggucuguccaguguggcuggacacacugaccugaucgacucgcugcugaagaacaggacuucugaggaguggaucaaugaauuggaugaucuuuuagggucacaguaacagagacgacugugguguuuucaguguuuagucaucuuauauuuuuguucucagauucaagaaagcaacuacuuuggaccaaaagccauggcccagagaauugggccaguagaaccuaagccacaccugaggccagcucuggucagucucugaugguccauugggcuggcucagcacauugacaucacuaacuaggguugggauagcuuccuacccagaugaccaaaaagccaguggaaacaguuaagccccuccauaucaggcuuaccaagaauaugugcccuguuuuuacccgagauuucuccacuugccucaaggcugggaacaaacuucuguuggaauuuuaaauaggauuauuugcauuuuauagcauaggcauaauuuuuuuaauuuaagauuuuuaagcagauuaggacagguggugguuguauuguaaguggcacugggaacccaggguuuccuugggaguugaggccuucuuuauuccugcucugucagcuuucauggucacuggaaaucacugccacaguacaggcugugacugcagaugccaaaaugauuaggaugccacagaugguacaucuagugguccagauaggaucccuccugaaaucuccuacuucuugucugccacucacucuugaggacacugggcccccauggaaucccuccaugcccuagcauggcuaaaugcugaagguggagguucagcaugucugacaacccggauguacaccguagaagugccauucaguuguacacacaucuuuccuccuccacaucauccccacgacccuucuaacuccuggccucuuccagccaaaacgggaaaaguggcugacuucacugcauuagaagaggaaaaguccaacuccuuagggagucugagccuggcacgggcuuggggaaagaaggcugcaggcagccugccgucuaggcaucacuuuauuuuuuauccuccagacuucugcuccucccacagcugaugacuugcacuuuuaaagugguuuuauaacacuaacccguccuugcuaaagauugaaguagguucucuuaaaaggucuauugauggacaugucugagcagagaaaccguggaauagaauauggugcgugggcugcuaacagcaagagggagcacuugucuucaucacaagcaagaugaugagcacagagugagaccuuuaacaggauggcggagggaaagguguuugcuggagugacuuccgugcagaguggucuauagagaaacuacagcucugcccauuguccugggguccuggaacuucguccaguguuaagaacugagccaaggagaagcacgagcagccuucgcaccuggagggucagaacgugcacacacugcuaacuaguuugcaccggcagugccuuuuucacugagggcaccugugcucucagguccuugucccucauagccauuucuccugccaugucccccccucccccagcccccagaaacucaguucagcucucagagaagcaggugaaucauaaagucagugaagacgccgcccucugauucuccccacuguagggggaaggaagggagugacuucaguggguucucuaccaaaaacagggcuaagggcuggagauggauccccguuccuuguccagccuccugcuaccgcugcccaccuccugccuccauugcccaggccacacuaguuggccccagcacucuaccuuaggcccaggcuggccacaggcagugggcagcucacuugcugcagugucauagcaauaaaaugugauucuuggggucugcccagagcugcccauggcuuuauuuaugaguguggcuuugaggaguugggaagagguaacccacuucucucccaucuucuccgagccaugacucaagaagaaaagggugcucggacucucuuauacacaugugcuuuguguaaauaaauguuuacaauuuuauauugaagauggaauaaguguuagagcguccaacuguauauuuuuuacuuuuauagauuuuaaaacugauccuuuauauguguuuggagcuaugauaaguuuuauggcaagcaguugguauuguuaacuuuuuaugaucaucaaaaguacauaaaaguccuauuaauccccuuacucugcuucccuuagcucugguauacaccaaaaagaaaucuuuacuuuccuuguguuauaaaaauaauaaaaauauuuuacuaguauggaaa

SEQ ID NO: 12471 - RNA, 7536 nt, Mus musculus
uaggaagcccccgccuggcugcggauuggccacaguggauggcuugaaauguggcugagcgcuucggacaccucagacggacgguggccaccccaagacgcgccccagcccgccauggcccggauccuccgggcauccugccuucugucccugcuccuggccggguuuguuccgccgggccggggacaagagaagucuaaggugagugaaccuccggagcucaagaagaguccauggcacccagguguccacugcgcgacugggagagccacugcuuccccagaggcaccgagagccucacuuguaacccucggucucugcgcucuuccaacacagacccgcgugcuucagagggcaguacuaacccaggagggcagucuuucccgaguuuauacauuuucuuccacugucaucuuggggucgcugguggccacaauccugaaaaaaaauugccggggaagagggugggccgaugguuucuucacucaucccagggcgcuggaggcagagaucugugacaggaagaauuuuuauuugggggcgcaucccuuucugggccucaguuucuccaucagcagggcguagcuggagaggauggcuggaaggcuauggaacccugcaguugcuuucccuauucacaguucacuggccugccaugcauggagcagacacuguagcuagagaagccaacccaggccaggaagucuucuggagcuucaucucuccuagucuagcugugguacccugaacuggaauagaaauggcgagccugagggcagaugccccggcaugcuuaucuucuuggucaggccugugcugggugggcucuguaggccucuccucuucccuagggugagaaugcagaaagcaugaacccaaagaaagagacugugguccccaacuucacacacaccaugcacaccaugcaccccugcacacuugcaugcgugggcacaaaacuggguaggcucuagcuuugaguuucuaaaauccucagggucuuccuucuaagaucuuguauguccgagagagagagagagagagagagagagagagagagauugauuagggggugugguguggagaugggguggggguggacgggggcacuagcccugugccuuuagugugggaacugcuuggguuggggguugaauccuguccugaggaggcugcaggaaagcacacuggccuugugcuguccauagaaugaaggagagaugggugaguucagagggaagagagagagcagucuagaaaagucuuagggugugguguuaucuuaucucauaacuagcugaagcuucuggcuccucacagcccaggcaugcccaucugagcucccagguccuuggaguuaacacauuacagcucuggcuucugggauucaacugcuugccuggauccaacuucagaacaagggaacagggaggggacgugugcagacccagugugauaaagccacugaaagauguccucuacacucaaagggaggggcaaggacagggaaagccucugucugguccagguuacagcugcagaaggcuuugcauagcuguggacuaccagcugcugacguggcauccuaguaaccacugguuucuaggugacugacugcacaaggcagagagcaucaugggagcacaggcugacgucaaggcugaaaggccuuaaguggaccugaaucccacuccaucuuacaguugacaggcuggaauccugagaagggggagggauggucacacacugccagaggcccagcuggguccagcugccaucuccaaccucucagaccugucaugcucccaacaucucaccaauggguguaggaagauggaauagggaagacauggaccaguaguagcccuaggcauccaggaagcuuagcucaguguauucccccccagccccaccccuuuuguuccucguucccuuucaguacucuucucuggccucccugguggaggaauagggcuaugggauucuaugaacccagaggaaggaagcugggggugggggugggguuggggacucaauuggugaguauaaucuauggcucauuuaucaagaccacccuccgaccuaugcuagccugggcccccagcaugagcccuauucuccucccauagaaagcauggcaguugccauuauucauuucuuagggcagcuagcacacaauuaaggccucucuguacuaugacccuuccaggccuuuggcccuugcugcagguaaucuccauguccugcuggcccaagccuguuuucaucugucaguaguuucucaaagucauuuugaguguugggaugacaauucgaugaguaaaaucauuguuauggaagcaagaggaucugaguucaaauccccagcauccaugaaaaagccagguauggccacacacgugccaacaauggugaggugguggggcagagacuggcagauucaggagcucaucaccagcagagucaaacacugagcacagcugacagggucagcaacauggcucuggggugacgaugcuuguaaccaagcuugagaccugaguuugauuccuagaacccacauguaggaacucacugggucuucccagcuguccuuugaucuccacaugcugugacauccucccccaaauaagugaauaaauguaaugaaauaauuuaauagagaaacucucacgauuuucuucuuuggcuuccacauguaacuggcuagacacacagccaaacaaaacagcaacaaacacacacuuuugagaggcaaauggaauuaaccucucagaccaaagcccaaaggauuaagaugguuugcucagggccacacagccgguaaagauaaccgagucuuacucaagggucuccucauguccccuuccuuaagacuauccggagaagcuggacccacggguguuucccauuauucagugagccucugggaucuccuccccacaucugagauucagcuugguaugaaggugaagcgccaugcagggagguagcaggguuguaucucacuguuuuuacuauguugcucuuguugaggcaagguaucucaacguagcccaggcuagcccuaaacuuuccaccuccuguuccagccucugaugcuggccuuacugaugugugacccccaagccugaggcuguuugccuuuuaggguggaagugaucucagcuggggcuucagaagccuggggcagggcuguccagcugagcauucagucuaacacucgcaguauuuagacucccggaaagcagggacuuugcaccccagccaggagagcugucagcugucagggaugacccagcaaaggcagccaggcucacucggcuggcuagccaggccugcagugauagaggcauuccacuguaccccacuggggcaccugcccugcugccuggaugacuccuucacccagugaggcugaaggccuugcuugggcagcacguuuucuagacccagagggaagaguaccuuccuaugaggcucucccacuucaagaggagcccuggaguuuugcugucccuguugggggugaggugggguggggaugggucccuuuccuccuguuucaguuaaaaauagcuaguccagcguaauagggaggcuggggaggagaaaugaucaagauagcacugagcugguggcagggcucgaggggaaccuggguacucuggcacaccccacugugcccuaugcuccuucccucauucuccuggagguagccuguggagugucagcuggacagacaggaggguguauggguuaauacccacugugucuucacucugggugucacagugaggccuugugacaaacuguuccauacuccggggcccuguucccacaucccugcuuccucgagcucugacucauucccaacauccugacacauccuuucuguccagugucuccuuccuggucaccuagcccaggcuuccucaugcuugucuggacuucgguagcagccacccaacugugccucucagaccaaccucacccaacugccuaggaaauaugaaagugguuucugcuaacuucagaguuccacagcacccaguaagcaauuaaugcaaauacugagugcuuacuggguccucaaguaucucaguuaugggagaugaggaauuaggagaccucagguuuaguccaguuccaguuuuuguuguccuggguaagucacucucucccugcuggcaaucauccaugacgggaagguggagaaauguccuaaauguguccacucuaacagcucccuucuuccaccuucuucucuuccagacagacugccauggcgguaugagugguaccaucuacgaguauggagcccucaccaucgauggggaggaauacauuccuuuuaagcaguaugcaggcaaauauauccucuuugucaacguagccagcuacugaggucugacagaccaauaccuugguaagagcucccucaggacuugcuacuaaaucuggacccaacucugucuuuuggggacacuuuaauaacugugagguacaagggggaaagggugguggugacgcacaggcccagguuuguaucccagcuccauuggauuucauacuuucuggagagcauuacguaagccugaggugugauggucuuuguacucuagcaaguucccggcuaccuuucuuuacccuagggcaccucagauaccuugaccgugugccugcuugcuucccuugucugcaguaagaaaugacagagguagcugcagcucacuggcugagaaugccuccucucccccuagcccccacuagcaugagcccgucucuuggcuucacucuggagaagagucccgcuagcuugaagcucuggagauugauggggaaggaugggauccugaagugguggcauccaacaguucauucuuuuugguuguuuauuuucucauaacaggguuucuggguagcccuggcuguccucagacuugcucuguggaccaagauggccucaaacucaggucugcuugccuccuaaaugcugagaucaaaggugugcgccaccacugcccagcucaacaguccauucucaagcaaauguuaaaggcagacuagcucagcccugcucuuaacucaguauccauccaggaaagggcaccuagggucaggguguauaaacgaggcuggcaauggcuuaacccgguaucugacuggaaccaugucuccuuaaugucucuauccugucuuuucuucucagugagggcaaacagaagccuaagggccaaagccugauggcccaagggcaaacacuuuggggccaagcagacccaggccacuuggcuggcaccugcaggagaguuccugggcugggugauggcgcugccucuaauuccaggggucccaagggaacuggcgagcuggccagggccuccccugggcuccugaauucccagaugagagggaugugaauacugcccuccaaucacccgaagaaaguccucagccaccugcccaggggcuaagagacccaggcagcaggugugacuacccauauacagaagcauacuccugacuucucucccaaaccgccacugcccccagacuggaggcucagccuugccacugacucugucaccccgggaaaguccucccuucuugggccucacagguuccagcagucuggaggguguugaggcagguucuucaccucuucucuucucucucccucgucaagaacugaaugcacuacaagaagaacuugggccauuuggcuuggucauucugggcuucccuuccaaccaauuuggcaaacaggagccaggcgagaacucggagauacuccccagucucaagugaguucucauggcuggagacggcagccucuauggggcagaggcucaggggcugcagauauugguugacggucuccacgucagccacucaguuacucccgcucccccauccucaccccaguuugggguuuaauggaaugagggggaggguacaggaaauaggaggcuguggguaacugucugggcagcacauugaaggguagagaugugggguggguauagagaggggcugagauggcagauacacacugggccuauguauguccaugcaagucgugcgcuugauaaaggagauucccagcccccuucccucaagucucuucaucuuaguucugagcuauguguggcugcucuggacucacucaaguacacuccucccagguauguucgaccaggugggggcuuugugccuaauuuccagcucuuugagaaaggagaugugaacggggagaaagagcagaaauucuacacuuuccugaaggugagaguggguaauauggaggaagcuccccuuagcggcuuaggcccuggcccacaggaaugucuuggcauuggucuaguagacccaugagagggcuuggcagacccaguccuaucacccuacugcagacguaagacaggguccacagccuuccagucagcauagagauggacggacagucaaguguucuuguucccgaacugggcccuucccucagugccaguuuucucccuggaagggaggggaggucaggaggagccucaagucagacuaacgccccucucaccccugcuccagaacuccugcccucccacugcagaacuccugggcucaccuggccgccucuuuugggaacccaugaagauccaugacauccgcuggaacuuugagaaguuccugguggggccagauggcauaccgguuaugcgcugguaccaccggaccacagucagcaacgucaagauggacauccugucuuacaugaggcggcaggcagcccugagcgccagggggaaguaacugaugcccccacccuaccccuacccccugcccaucaugcaagggccgaggaggggcucuucaggaaggaagccacauucccagucauucuacccccaccccagauucucuuucuuauuacauaaaagacaagccuggcacaacugugugucugaaccacuguggacacgugacaauugucccagugugugcauggcuacacagccacguaucugccugcuugaaacccagggaugguccaucuguguuuacggcuuggcacaacacccucauauuuuuuucagcuuucuguuccaaaugagcccaaaggaaacacaaguucuagguccaaugguucugcucaaaccugaacaucauucuuggggccagcaucucccacaugcccacacuacacaccaccagccuccuucuuccuuccugaaggacccuccugagcccccaagcccaucccacagugcuccugagaccagccaagacaacugugagcgcgauggccguguaccccaggucagggguggugucucuaugaaggaggggcccgaagcccuugugggcgggccuccccugagcccgucuguggugccagcccuuagugcauucaggcuuaggcucccaggcagggacacuacccccgcgccucuggaggacaugcuauccucucacucuguccacugguaucucaacacccccaucugcccaguaaaggucuuucugcagcaguucagccua

SEQ ID NO: 12472 - RNA, 16857 nt, Mus musculus
ucaaauaguuaagagacuuuauucuaacagcuauaauuacagugcuugucgaaaugaaaacugaaaacaaguauacaaaacaguugauuacuaauuguguauugaaagcgguaagagguuccacgacaccaaauaaaccaguucugagauuuccccaagauaaauuuaacagcuccagcuucuucaguguuuaucaaaauacaaaagaaaaaaguagaggucgucuuucgauggcaaaucggacccuugcaggcugagggaggaagcuacuucacacauggagaugggggugcuccaggaugugggucuguaauggaccgacccucccaccuugcacgcacuccugcuggugagacccaggccuccugccagcgcguccaagugggcccaagaguaggcuggguaugcaggcugccauugggccuugcacacaccaaguacaagccaggcccugcaccccacaauggcucccagccuacccuagguaaccgugugagcacaaguacaagcacaaugcuauggaaugcaggugacccaaagacaggcgagucacgggggcucuacugugaccaugcagcggauggugguuuguucaucaccuucucuccuguucccacagcgaaacaggugaucugauaucuagcauucaggccauuaacugcaaaaccuacacuaggcauagucuccguucuguguguucaaguguucuuguccuguauuuuuaacuauuuuuaaaaaaugcacugaguuuggguuaaaaaccaaccaccaaauggauaccgacaccagucuacagcccaauggcucccggaggccaggugccccuacacccaaaucccuucucaguacugacaguugaguugauucucuuuuuacaauaaaaaagcuaaguaauauugcauaggaguaccagaaacugccucaguggaaacagaaacuauuuacauuaaauaaaaaccuggcugcaggcugcgucugcacauguacagcacggugcgaugcacacugugaccaacccauggagacagcuucuggcacucaggaccacagagucgcacguuugccacaugagaggaaagcugagggcggagaagaggaagugagggggagggaggggucugguucacuucugguuccggagcugauuagacagccaaucuaguccuucauagagcccguccccgcugguggcacagguggccugaauguaccaguuccuguggcguagagagugcagccccagcuugucugugauuucggccgcauucauggcauuggggagguccugaggaaaaggaagaauuaguggcagggaccacaaacagccaauaacccuggguagccuuucaccccuccucuuucuucccugauacagguuuuccuucagggaaggaccuugcuggugccuaccugcuuguuggcaaacaccaagagaacagcaucucggagcucaucuucagcuagcauccucaugagcucuucacgggccucguucacacgcucucugucauugcuguccacuacgaagaucaagccugaaacauggccacauuagugcacauacugaacacuccccaccagaccccacagguucuagauccaguccuuccacuggccgugauguuugguguggcuucaugcccugaaauggcaaagaccacaaggcucagugaaccaacuguaucccuuugaggcaaauaugaggaaucuaggacaaggacuggcugcuuaccuuggguguucuggaaguaguggcgccacagcggccggaucuuguccuggccgcccacaucccacacggugaagcugauauucuuguauucaacagucuccacauugaaaccuggggggcaggacugcagcugagggccucuguauuuuggauccccacacccaacccccacccuggcccugggcccagcuucucaccaauggugggaaugguggucacaauuucgcccagcuuaaguuuguauagaauuguugucuucccugcagcauccaggcccaccaugagaaugcgcauuucuuuuuugccaaaaaggcccuugaagagguuugcaaagauauuccccauguuuguggacagguggaaucgauacuggccaaagaccugggaaagaaaagugguucaaguacuguuaugugcugccagugugggcccuguggcaggucagagacaccuauguaggaguccccugcccuaagccauguccucauaucccuccugaaauuucaugggaggaugggagacaauucaauccuaggucccagguggcagcaaagaacccugcccccugcccaccagacucccuacgcucaccaaggucacacauaucaguuuaggaagacgcagauaccacaacaaccccuugucucccaagucuaaucacuugucagaaugaagggacaucuaacuacaaucaaguaugcucacacucgggagcuggcacuaaaaagaguuuugagagaaagggccuuuuuugggguuuguuuugguuuuugguuuuuuaagacaggguuucucuguauagcccuggcuguccuggaacucagaaauccaccugccucugccucccaagugcugggauuaaaggcaugcaccaccacugccuggcugacacagggccucuuaaaaccuaacagagcucuucacaaaaucagaaaaaaccaccuuacaucucuauucuuacuucaaagugucaaaguauccacaauuuucaacuaaagaaauagucacacucuaugcucaacacuacaagccaaauguucuaccagccccuggugacagcgagacuagacaagcccauaagaacugugaugccaucucuccaggcauuucugucugcccaggucaugggagacagauguuaagacaguguucuaucucaagucgcaagaagaaagagacucaaacaguaaaccauuggcagcacauuccuauaagaggaugacaggcaaaugugagcugugucccugcaagggccuaugcauacuuaguagguaaggcccacuggaagaaaagaaacgcuaggcaauuuaguugguaccaauguaccagggccuaucaaauguuaagagcuucugggaaggauaguaagguuucccuaggucuggucucaacaucugguggccacuuugaucuucacuucucauccaaauggauuuacugcuugcuuugucaaaugcucauuguuaacucuuaauaagaaaagcaaauagaaggccacagugccuucagaaagaguugucaauccuagguauuauccaaggcuacugacccauaggaaaaagaaugacaaaguuucccuauaaauugucucguagugcuaccuuaacagaacaucauacagugggcaacuuggcaacaacagauacaguagacauccaaaucauggucuggcagguuggaugucugacucuaaggugaggucuucagccguauccuucaggagaggaaugccauaaucucauguagcaaagugagugugaacuugcaaaguccuccuccugauggccauuauccauucuugaggcuggaacuuuaagaaccaaacacuugcccaacguuauuacacugggguucaauuucccauauaacuucacuuuggaaagugcauucaaaucauaguaugugaaacacaaaggauuaguaguacuauaacauggacuauagacaggaccauguggccuccccuuuucacgugcagguguguuaaggggcauuauguggaggacuucauacaccauuuuucggggcucaguucuguaaccucuuauuacauugugcaaacaguugacuuuuuaacacagucacuuccacuagccaguuaagcaggcucuacaaagaaaauccuucauuuugggggauacccccgcaaguuacacauuacacugucuuguucaguggacugaugugauggcaccaugucugagacauggccuacaggaccccuucacaccaucucuaguacccucuagacaauguccucuucuuagguaauguaaucaaaaguuauacaauaugaugcuuauguuuaagcagaugaacauucugcacuccccaaaaugacuacccauaugggaauaaaaauauuaggagagagaaaaaggagauguugaggauuacacacucaauucuucacuuuaucagcuaagacagagcaaugauacuuuagcacuaaaggccuucuacuucauuuuuuguugcuuuuuguuuuguuuuguuuuuuugagacagauuucucuguguuaccuuaguuauccuagaacucaacuucuucuauagaacaggcuagccuugaacuuacagagauccaccugccucuacauccgaguucuggaauuacaggugugugucaccacuucacuucuuaaguacuccuuccucaaaaaguucccagaaaaaucccaggauggguucaacaguacagaagccacagugacuaaaccccaaacaagugaacaacuggagucccugggacaguggucauggauaggauccagccgugaguaccuucagccccucaugguguguaagagcaguugaaccacaggacagagauauggggcacucucagaaugccccagaagauaugaacagaagcagcuccucaaagccuagcuccaucucucuuuaaaagccucucuaaaagccuuuuugauuccaaaaagcaaaaagggagccuuuuugacuggaagcaagccaaaacaggagagagacuacuuagaaaccaagucaccagggcuagagagacagcccagaaguuaagagcacugacugcucuuccagaggaccugaguucaauucccagcacccacaugguggcucacaaccaucuguaaugagaucugaugccuucuucuguuaugcaggcauacgugcaaguagagcacucauauaccuaaauaaacaaaucuuaaaaagaaaagccaccacaaaaaaaucaaacaaacaaacaacucaggguagggauggagcucaguuggcagagcauccaugaaaucccaaguucaauccccaacacuacauaaacaggguaugaugugcaugcguguaaacccagcacuagguagauagaggcaggaagaccagaaguucugccucagcuacucgcaauuuugaggccagccuaagcuacaagagaccucaaaaacagugugagauacgguauuucaugccuuuaaucccaccaaccaggagucagagguagguagcucucugaggucaaggccaggaugguuuaaaaaauaagucccaaguaacuugagggagauagugagacccugccucaacaacaauagaacaccccaaagccugaauguaucaguacagagguccaccaagaacaggauacuggaacaaaagaaaaugagggacacgaaaaguucaaaaugaaggcucacagaaagcagaauaggaaaaauaugaacacgaugacagaaaguaugaggcuaaucuggaacauauagugagacugucaaagaaaaaggaggaagaaaucuagauguugagucaugccuagaaucccagcacuggggcuagcagauuccagccagagucugagaccuuaccuaggaaaaacuaagaaacaaaaccaacuaccaaacaaaggaggaagaacaugaagacaagacgacgggagaggaaaguggaaggaaaugagaagagaaagaaaacagauggacaggacagauugacaagaauaacuacagagggagacucuuagcuaggcagagggagcacaugcucuaagagcugcugccuacugccaaaacacucugugacaaugacaaugcagucagugcuggugggaggaagacucucaggcaacgcucuuuaaaaauucugagauuauggcucucaaccuuuaauuccuaccaauuauagauaguuaaaaacaauuucaacaugacaaggcuucccaugaggauccaaaccaggcaaaagaaagugagcccaagaugaauuaagaagaugccagagagcaggaagcacucaaguaugggggaggggaggaccaaggaggcaauacacauaauuuauuuuaaacaaaaaagcuccacagauacagcuuaacuaucugcucagcaaucaguuguccuucuaaaucaacacaucaaaaauggugcacgccuuuaaucccagcacuugggaggcagagacaggugaauuucugaguucgaggccagccugaucuacagagugaguuccaggacagccagagcuacacagagaaacucugucucggaaaaaaaaaaaaaaaaaaguuaccaauggagaaacaaaagggauccaccagaggugacuagggugccaccagugugccaggggggcuugguaaggcagaggggacauuaagauagcucuuuauguucagaugcugugaagaaaacaauaguuguugugcucacuauccauguaugagcaaauauaugaccccaguaagguugaggcagaguuuaagauccuuggcuaugaguaggggguugaaggacagucugaacuacguaagacccuguuucaaaaggaaaagcaggaccccccccccaaaaaauccagaggaagauuaaggggagaggauaugugcaccccucucaagucccuacaguagcagacagacaccuugaauaacugugucuaguggcggggaccucagccaaguuugccugcaugagugucucauuguccaggacuacuguuauucagugcugcuuucuugcaugugaucugcacagcccacagcugagugugcugggccuaaccugccuucucuauggaaaggccaugauaaccacagugaacauuuucuuucuuuuuaacaagaaucaccuaggaagaaggaaauagaauucaaugaugaguuccagauuuaagacauucaacaaugcaagcauguagauccacccuacuguucacacaggcacuucuuuguccucauagggccccaaccacugcuucuagaacagacccaaacccaaaggagccuccacagagagaaaagccuaguggcuacaagggccaaucaucaccagagacucuggguacaggcacugacugcuugaagccaagucaaguugcugucaccuucccucuucaaucccacacacaagcuaaacuugcuuuuccgguucuucugcauuacucacuccaucagcaggcagugaaaacaacuuucccagagagccucuugcugguuuauucugccuaccaaacuaccagagggagugccucaggcaggaggacccacaaccaccaaguuaguugggggucaagaaaguucauucuuuggggaggagaggacaaugguugaaguagcuucuccucuggcaaccacacucccuacaccacccucuguacagacccucuuccuggucucuuaaguaaaggcgagaaaacacaacugaguccacaccuauuccacaauaaugaaugcaaccugacugguuuaguaguugaacaggggccugagcagcagccaagcgauagccaggggaagucaaucauccuuccacaagacucagaaaaggccagacaaccuucuuuaaaucggacuguguagguuugccauuuuccuccaauuauuaccacuauuuugaaagaaucccaguagaaagagaaguuuucugcucugggcugcagacucaacagaauguucugcccugacuaggacucauacuuacuaccugaaugaaaaauuggugcugucuuaagaguuccuuuuagggaacuagaaagauggcucaauggguaagaguacuugcugcuuuugcaaaggacacaguuccauucccagcacccacauggcagcuuacaacuguccuuaacuccauccaguuccaggggaugugaagcccucuucuggccucugcaggaacugcauacagggacaacacuaaaacacuggagccagagcuacaggagaucugccucaaaaauaaaguuuagccacauccaucaaggguauauucucaguuaucacauuugaggaaacuuaccaauuuuaaaacuuuucuuaaagaacuugaacacaguauaaaacacuuucuaacuaaaguuuuuaguaaagaguaccaguguucaaaaauaaaauacaugaaaaccugcaacuuuaaaggggcuuuagugucauguacaacaugaccacauguugaccucuguacacacugcuuuuuguacauuaacagagacugagaaugucuguugcuaaagccgcaggucuucacaugccccucagcugaacauuccaggcuucuaaguauguccaugcaauccaaguacugcucuacauuuugucguuauuucauaaaauuugcuuaagaguaaaauugaaugugcugauacuaagacaggcaagcacucuuggaagggcaaaacugugacucaaucaacaguugcacacugccuccucgaagcuucuucagggcaggggaaacacaccaggucugaauuguagguaggaugaugagugaaauugaaauuagagcauucuuugcaaacuuaaggugaaaccccccccaacacacacacacaaaucaaggucuauacccauacucaaguuaaaacucuuaaguuuuugaacuacagcaacuaaaaugcugaaccucaucuuuauauuguuucuccauuuauucauuuauuuauucauucauucauucauucauugcuuuuuuuccgagacaggguuuaucuguguagcccuggcugucuggaacucacucuguagaccaagauggccucgaacucagaaaucugccugccucugucucccaagugcugggacuaaaggugugcaccaccacugccugucuucccuuuauuuuuaagcauuaccauuucuuaacauaacuagucucaaaaaggugaaacacauucacagccacauuaacucuauacaucagcagcucuaagcaaauaacugagcuaccauaucaccuguaguagagcuacaauaaggaauucaugaaacaauuuuugaaacuucuaaaggcuccaauggggauacaucuugccacauuguuuguguaaaucuucuuaaagcagauaccuacuguucugugucuugucuuccucucaggaacagaaucuggacuuguaacuggagucagggcuuccagaauaauugcacauucuggagcuuccugcagcacuacaugccuacagcaccuaccuaggagccacagaaccacacccaaacacaguaguucucaaccuguggguuucaagcacuuuagggggucagguaucagauauccugcaauucacaauaguaacaaaauuauaguuaugaaguagcaaugaaguaauuuuaugguugggggucacaacaugaggaaagggaacagaagggcaaagcaauagauaagcugagaaacacuguccuaacauacacugcuaccguauuucuacguuggcaggaaguacagagagccucuacuccaucucacuggaaaaacuccaaaacuauagauacagaacuggaaacagcagcagagcacuagguuugcucccccaaaccauagacaaaacaaagcaagaaacauacacaggcaucaaccaagaaacacaucuaaaauggagaaaagcacaguaugacaacacaaccguccugaaaucaggggacaaggcucagccuggcccucccuagugacccuguagccacuuguucugucuucaugucaaucgacaugaucacaugacugccagccuaggauaagucuggugcuucuaaggaagucucuauccugacuccuugaaagagccagguuggcuguaaccccagacccuagcccuuuacuccuuuccugaacacauauauggagcauacaauuuguauauaggagacaauuccaccuggcuauaaacagaugcaacuuauuuuggucacagaauggaauugaggagaaaugaccuaaggucauacccugaucuuacaucuucagauucacauccauguuggcuaacaugcacauucucuaaccauugagggcuccugcugaagcaaugaggcugaaccuccaaguggcuguggcuucucaauggccaccccugcuccacuggucuuuacagagggcauaguaugcacaaagccaugccaaguaucacauacccacauauaacaccaccaucccuggccucaggagaagcaggaggacccagaagagcauuaauuuuuguugaaaggcaaaucaaaguaauacagcuuugccagauuaucucuuuaugagcuucccccaugcccagaaaacaccacacacacacaacccccugccugugaggccaauggaucuggaccuggcauacuacuaaaggcccacuaaagaaaaagggaacuggaacaaccaacagcuaguucauggugcuuucauaaaauaagcucuuccucaaaccagcuacaauuggcaggguacuguucuacugaaacucaauguuaaugguacauucagccauacuuuggacaaagagucaagauggccacuagaguacuuaaugagcuugaauaauucaaucuucaaaacuugacuuucccuaucaccaugguuuaagaucuguaauccuaacacuacagaagcugagacagaaggacugcccugaguucagggccagccuagguuauaguuugagauugucucaugacaacaaaaacaaggagcuagagauggcucagcuguuaaguacugcucuuacagaggaccagaguucaauucccagaacuuacaucaggcugcuuauaauggucuguaauacaacuccagaaggaucugacacaucacugccuccuuaaacaucugcacucacauaucccuauaaagacacacacagacacacacauacacacacacacacuuuaaaaauuaaaaaaauauuaauacaucuuuuaaauuaaaaaacaaaagccucucgaaaaaccaaaaaacaaaacccuuaucucuaccuuugggaacuuuuauucugaggguagaagugucaugccccuucuucugaaacccuugcucuucagguagaaacagagggguaaaguauacgggaaggcugagcugucacuaggcucccuucagcucugguccugccccgcccugcuggagugaggcagacacacaggacaaagaccaaauccccaaguccacuguccuugcugagccuggcacugcuagccacacaucacacacuauuuccccuaccaucucaaugucagaaaagcuucucuaagacacuauaaaaguuuuuuccucuaacuuaggugaccgucacccagugcauucucuaacaauugccccuauucucuggguaaggcucuuccauguuucauauucagcuuuuccaucaaaaucucccuccuucccaaauuuccacccaguucuucagacccaaaccaaggagacuugcugccuccaccucccacuacacuacaacaagucaauuaaucaggugcaaaguggcaccauuaauauuaggacccucacauauaguagcuaugagaauuaucagguguccaccauaccuucaaauccacuaagucugccacccagaaaaaaagccaacagacaaucugacauuugcacaagauugaagauugccaugagccuaccccaaaugacaucacagggacacaaagggaaguaacuucuaucaaaacucugcuuuauuuauugcuaggccuagccauucccuuguccccacgaggacaagggggguggcuggcuacugaggcacuaagugccaaccauagcaaucucaagggcaucccaucucaaagaaguacuuuuuuucucugaaaaauaaggacaucuuuuguuaagguacugaagagaacaaaauacacuauccuugacuuacaagauaguuaaaguuggguuccuggaagaccugaaacaucuguuaacaugaugccaaagaaaaguaucuuucugugaucaagcuuaggcuaucacagagggauuuuccaccuacaugaaaaccacacaaguggcuaagugccagacauaaugccucccuacaugauagagccaaaggguucccacagauuucaaaauacccugaggacuacaaagcugcuucggggaccagggcacccuuucucuagucuuacccucccauacagcuccuggcaggguuccaaacucaagaguacacuuacccagcucagagcccuccuaucaauuguccugggcuacuaagaggccucugguuccucccucaaacuuaccaaucuuuuucuaucaucucugcaaaaaugucaccuuagaggugacauuucugccuccuuggguugguaacacccauacauguuguuuuaaggaggggguggguggguguaaucucucauugacccuggagcucacuaauucagcuggaguggcuuacucacaaaguccuggcgauccuccugugucugccuuccuccugcugggauuagaaggucugugugugaaguggggauuuaacucugguccucaagcuugcuugugcagcaaguauuuuacucacggagccaacuccuuaguuaguuccuuucaagacacacauucacugcaguauaaauuacauauauuuagccaggcaugggaaucagaggcagucagaucucugugaguucaaggccagcauagucuauagaguuuaggaugguuaagaugaacacuccaauaccaugcauagacaggcagcuuugugcccaaugcugaguaaggcuaccacuuccaucuucuuccacuacgccccuuacagauacuccuuaucagaggcaaaagcaauguuguuuuuaaaaauuaaaaaguuuaaaaguuaaaacacacacgugcacacacaacuucagagaggcuaauccuaaugacucaggaaaaaucuacagggccaacaacauggaacaacauuuacgcaguuuuaaacuauguacaaguugugcuucuauguaaacacuucuacacuuuaacugcuagagacuugggggggggggugcacagaccugggaacugaaugaagguaaagugacagcacagaggaagcaagguauccaucaaauuuaguccacaacuggcagcuuuaaccacacacuucaguuaaucacaaugauauguccaaagucugauauaacuugacauaauagaaaugcuaaaagcugaaaauaacaccaaucaaaauuucaccaccaaagucacuagaagaugggcguauguaaauauaacuggcuggauucaaacaaggaagaagugcauuguuaucuacagaagaacaggaagcuucagagaacacucacaacgucaggccaccuagacuuccuucacucuucagcacugagucucauuaaaucuagaaaccccuuucuuggccacaugcaccuaaacuauaccaacagaauuaaacaaaacaaaaaacuuguuagaggacaacuagagaaucuaggccacaaacauuccuguuucaguauaugguacugcaaaaauauuuugacaacugauucugacaaaaaacaagaaagcuuuuggaaagaacucugguuaaagcaucccuuuaacagguauacuuaccuuaauaaauacuaauuagaagacuuuuuaauucuuucacacacuucuuaauuccugaaauguccaaugauaauaaccaagucccacucacacuacagcagugauucucagauccucagauauggggagcugcuggccaccugaacuuaauugcccccaacaagucuguaaacuaugccugccuagcaugguggcacagcuguaaucccagcaggcugugaucuccagagggcaggcaggaggaucucaaguuugaggaaaaucugcacuacacagugaaacccuuccugaugaacagcaccaacaaaauauuggccagcuguccuauuuucugucaauucugcucuuaucacuuaaaacuuucccuauuaucaaggccugcagagagugccacuguuccuagucuauuggcugcugaaggcuaccaaacuguuaccacugugaguaaaaaaucaggacccaggaucagauaagugugugggguucucaucagucucccgacuaucugcagcagcacagggugggggaacucgggggaacaccuaaaaggucccccuggaaauagagauuggaugugccuacacuaacaaguuuuccagcuaaucaggucacuugacccaccugagagggcugaguuacccuucaggacauugacaaaccguccaagcuauuaucuauaaucuguaucacaaucaauauuggacacagacguugguguguaaugaggaaucccaauguauacacacucccacccccagcuaccuuuuaacuucucaguaggcaaugucaaaucuucaauaguagauagagaauacacacaaaaagaugcuauugcgugucaaaucucaagucaaagaaauuuccauuuuucucuccuuaccaucucugacaauuucaugaaaaggucaaagagauucaagaaagacaacagggaagaccaggaaugacagagcaaccuagagcagcacagccuuugugauuacgaguagauuuaaaccuguauaucagagccaggaggugguggcuuaugucuuuaaucccaacacccaggcagauuucugaguucgaggcuagccuggucuccagagggaguuccaggacagccagggcuauacagaaaaacccugcacaucaauguaacauuuaauucuaagaaucugaaaaaaaaaauugaccaaacaauuucaaagcauugugacaagcuauugcaugaacuugcacaacaaguuuuuucucuugguuaggcugccugacacuggguuaccacagcaacugcuggucuaauuuaccuuuacuuuaaaaaaaaaaagaaagaaagaaaaagaaaaagaaaagguauuuugaagccugucugguccugggcagaggaagcagcccaguggagcaaagauucugaauauccguucuacaaggggcaaggggcacaguggacgucccagaugcaugacuuacaaucacagcugugugagggccacagaacuaguuacugcuacuuuccuuucaggaugaguagacugaguaugagucagcuguuauucacacugccuuaaaccuuguaugcagugcuagagauccaaaccaagacuucacgaaggcuagaaaagcacucuaccaucuagcuccuaaaccuuuuugaaguagcaauucuguacaucugccucacaagcaagagaacaguguggugauccagugacucagacccauuuucaaaucuaaggauaagugagagacauuccaauaagggaaaccuuuaugccacagaagacaauguaguucacacaucugugacuggcccuuacaccacacaacucucuggagaaacagagaaaccagguaguaacacagugcaucaaaucucauaguuuaggcuauuucugcuagugcugcuaaaaguucaaaagugaggacacuauagucaccuaugucaggcacuguggauacuggcuaagacagaggagagacacgaggccagcacacaaagcaccauggcaccucacuagucuucugacagacacggcagaaaccaccagaaucagccugcaggaaaaacugcugaccacuaguugugaaacaagaacuacaacagaagacuccaacauggguuguggcaucaacuacugggcucuccaaugacuucugggaccaagagcagcugacccuuccuuuccugacaaagcagccaguugcuguuugaaugggagaauuccuucuugaugugaacagaaucccuagcauuuugcauuuguucuauguagcuagaccauacaacauauguagcuaccuacacuacaaacugacauggcacgaccacccuaaauggacagccagaauuguguacuggaccuggucucuguaccugcggacugcucagaggccgggaacggguuauuccaugggcagguuaaagauucuccaauucagaauggccuuucuaauccacccaaaagugcauaaaggagccggucaagaggcgaaacaaggcucaaaccccuccgggggccaucggcaccccaaugcagaucucaccgacgauauucggggcccaaaucacggcuaauuggggaucacaguggguauucugguaucccccgagauccgcaaaugcgcguguuaaaucccagcaccuggauccgcaguucggagccccuguccgacaccugucccuuucccuucccccuuccuacaacuucgguccuccaggccgacaggaaccggacucgagagacagaagaggaagaccucgccacccgagugaccuugacgucgucucggggccacccgagccucaguuuccccaagcccgcgguucaugccguaucugaagcggccggcuagccuuuaagaaggaaaaccccgugaccccccgaacccugcuccccgcucccaggcucucgggccguggagccuaggagaggcgcagagaggaacagcaggaaaccuggcuuccuggagaagagccggcguccuggccggacuuccgggcugcggcccgcggcgggcggccaggcaggcguaagggccgcggagugggggagggccaagcggccgugggcgacgcgggacuccggggcgucccgauccucuguccggccugccgccgagcucacugagcauagaccucaggccgcccgaccggacucgguccuuagcagccgcagcugagcgcccccuugacucccacgaugaccagcccgcggccuccccaguuucggccucagcgcgccccgcgucucaccuccgcggcggcugcucccagccaggcguugguuucgcucccacaagauggcggcgcugacggcagccacgucagcgccugccgcggggcacgcc

SEQ ID NO: 12473 - RNA, 16857 nt, Mus musculus
ggcgugccccgcggcaggcgcugacguggcugccgucagcgccgccaucuugugggagcgaaaccaacgccuggcugggagcagccgccgcggaggugagacgcggggcgcgcugaggccgaaacuggggaggccgcgggcuggucaucgugggagucaagggggcgcucagcugcggcugcuaaggaccgaguccggucgggcggccugaggucuaugcucagugagcucggcggcaggccggacagaggaucgggacgccccggagucccgcgucgcccacggccgcuuggcccucccccacuccgcggcccuuacgccugccuggccgcccgccgcgggccgcagcccggaaguccggccaggacgccggcucuucuccaggaagccagguuuccugcuguuccucucugcgccucuccuaggcuccacggcccgagagccugggagcggggagcaggguucggggggucacgggguuuuccuucuuaaaggcuagccggccgcuucagauacggcaugaaccgcgggcuuggggaaacugaggcucggguggccccgagacgacgucaaggucacucggguggcgaggucuuccucuucugucucucgaguccgguuccugucggccuggaggaccgaaguuguaggaagggggaagggaaagggacaggugucggacaggggcuccgaacugcggauccaggugcugggauuuaacacgcgcauuugcggaucucgggggauaccagaauacccacugugauccccaauuagccgugauuugggccccgaauaucgucggugagaucugcauuggggugccgauggcccccggagggguuugagccuuguuucgccucuugaccggcuccuuuaugcacuuuuggguggauuagaaaggccauucugaauuggagaaucuuuaaccugcccauggaauaacccguucccggccucugagcaguccgcagguacagagaccagguccaguacacaauucuggcuguccauuuaggguggucgugccaugucaguuuguaguguagguagcuacauauguuguauggucuagcuacauagaacaaaugcaaaaugcuagggauucuguucacaucaagaaggaauucucccauucaaacagcaacuggcugcuuugucaggaaaggaagggucagcugcucuuggucccagaagucauuggagagcccaguaguugaugccacaacccauguuggagucuucuguuguaguucuuguuucacaacuaguggucagcaguuuuuccugcaggcugauucuggugguuucugccgugucugucagaagacuagugaggugccauggugcuuugugugcuggccucgugucucuccucugucuuagccaguauccacagugccugacauaggugacuauaguguccucacuuuugaacuuuuagcagcacuagcagaaauagccuaaacuaugagauuugaugcacuguguuacuaccugguuucucuguuucuccagagaguugugugguguaagggccagucacagaugugugaacuacauugucuucuguggcauaaagguuucccuuauuggaaugucucucacuuauccuuagauuugaaaaugggucugagucacuggaucaccacacuguucucuugcuugugaggcagauguacagaauugcuacuucaaaaagguuuaggagcuagaugguagagugcuuuucuagccuucgugaagucuugguuuggaucucuagcacugcauacaagguuuaaggcagugugaauaacagcugacucauacucagucuacucauccugaaaggaaaguagcaguaacuaguucuguggcccucacacagcugugauuguaagucaugcaucugggacguccacugugccccuugccccuuguagaacggauauucagaaucuuugcuccacugggcugcuuccucugcccaggaccagacaggcuucaaaauaccuuuucuuuuucuuuuucuuucuuucuuuuuuuuuuuaaaguaaagguaaauuagaccagcaguugcugugguaacccagugucaggcagccuaaccaagagaaaaaacuuguugugcaaguucaugcaauagcuugucacaaugcuuugaaauuguuuggucaauuuuuuuuuucagauucuuagaauuaaauguuacauugaugugcaggguuuuucuguauagcccuggcuguccuggaacucccucuggagaccaggcuagccucgaacucagaaaucugccuggguguugggauuaaagacauaagccaccaccuccuggcucugauauacagguuuaaaucuacucguaaucacaaaggcugugcugcucuagguugcucugucauuccuggucuucccuguugucuuucuugaaucucuuugaccuuuucaugaaauugucagagaugguaaggagagaaaaauggaaauuucuuugacuugagauuugacacgcaauagcaucuuuuuguguguauucucuaucuacuauugaagauuugacauugccuacugagaaguuaaaagguagcugggggugggaguguguauacauugggauuccucauuacacaccaacgucuguguccaauauugauugugauacagauuauagauaauagcuuggacgguuugucaauguccugaaggguaacucagcccucucaggugggucaagugaccugauuagcuggaaaacuuguuaguguaggcacauccaaucucuauuuccagggggaccuuuuagguguucccccgaguucccccacccugugcugcugcagauagucgggagacugaugagaaccccacacacuuaucugauccuggguccugauuuuuuacucacagugguaacaguuugguagccuucagcagccaauagacuaggaacaguggcacucucugcaggccuugauaauagggaaaguuuuaagugauaagagcagaauugacagaaaauaggacagcuggccaauauuuuguuggugcuguucaucaggaaggguuucacuguguagugcagauuuuccucaaacuugagauccuccugccugcccucuggagaucacagccugcugggauuacagcugugccaccaugcuaggcaggcauaguuuacagacuuguugggggcaauuaaguucagguggccagcagcuccccauaucugaggaucugagaaucacugcuguagugugagugggacuugguuauuaucauuggacauuucaggaauuaagaagugugugaaagaauuaaaaagucuucuaauuaguauuuauuaagguaaguauaccuguuaaagggaugcuuuaaccagaguucuuuccaaaagcuuucuuguuuuuugucagaaucaguugucaaaauauuuuugcaguaccauauacugaaacaggaauguuuguggccuagauucucuaguuguccucuaacaaguuuuuuguuuuguuuaauucuguugguauaguuuaggugcauguggccaagaaagggguuucuagauuuaaugagacucagugcugaagagugaaggaagucuagguggccugacguugugaguguucucugaagcuuccuguucuucuguagauaacaaugcacuucuuccuuguuugaauccagccaguuauauuuacauacgcccaucuucuagugacuuugguggugaaauuuugauugguguuauuuucagcuuuuagcauuucuauuaugucaaguuauaucagacuuuggacauaucauugugauuaacugaagugugugguuaaagcugccaguuguggacuaaauuugauggauaccuugcuuccucugugcugucacuuuaccuucauucaguucccaggucugugcacccccccccccaagucucuagcaguuaaaguguagaaguguuuacauagaagcacaacuuguacauaguuuaaaacugcguaaauguuguuccauguuguuggcccuguagauuuuuccugagucauuaggauuagccucucugaaguugugugugcacguguguguuuuaacuuuuaaacuuuuuaauuuuuaaaaacaacauugcuuuugccucugauaaggaguaucuguaaggggcguaguggaagaagauggaagugguagccuuacucagcauugggcacaaagcugccugucuaugcaugguauuggaguguucaucuuaaccauccuaaacucuauagacuaugcuggccuugaacucacagagaucugacugccucugauucccaugccuggcuaaauauauguaauuuauacugcagugaaugugugucuugaaaggaacuaacuaaggaguuggcuccgugaguaaaauacuugcugcacaagcaagcuugaggaccagaguuaaauccccacuucacacacagaccuucuaaucccagcaggaggaaggcagacacaggaggaucgccaggacuuugugaguaagccacuccagcugaauuagugagcuccagggucaaugagagauuacacccacccacccccuccuuaaaacaacauguauggguguuaccaacccaaggaggcagaaaugucaccucuaaggugacauuuuugcagagaugauagaaaaagauugguaaguuugagggaggaaccagaggccucuuaguagcccaggacaauugauaggagggcucugagcuggguaaguguacucuugaguuuggaacccugccaggagcuguaugggaggguaagacuagagaaagggugcccugguccccgaagcagcuuuguaguccucaggguauuuugaaaucugugggaacccuuuggcucuaucauguagggaggcauuaugucuggcacuuagccacuugugugguuuucauguagguggaaaaucccucugugauagccuaagcuugaucacagaaagauacuuuucuuuggcaucauguuaacagauguuucaggucuuccaggaacccaacuuuaacuaucuuguaagucaaggauaguguauuuuguucucuucaguaccuuaacaaaagauguccuuauuuuucagagaaaaaaaguacuucuuugagaugggaugcccuugagauugcuaugguuggcacuuagugccucaguagccagccaccccccuuguccucguggggacaagggaauggcuaggccuagcaauaaauaaagcagaguuuugauagaaguuacuucccuuugugucccugugaugucauuugggguaggcucauggcaaucuucaaucuugugcaaaugucagauugucuguuggcuuuuuuucuggguggcagacuuaguggauuugaagguaugguggacaccugauaauucucauagcuacuauaugugaggguccuaauauuaauggugccacuuugcaccugauuaauugacuuguuguaguguagugggagguggaggcagcaagucuccuugguuugggucugaagaacuggguggaaauuugggaaggagggagauuuugauggaaaagcugaauaugaaacauggaagagccuuacccagagaauaggggcaauuguuagagaaugcacugggugacggucaccuaaguuagaggaaaaaacuuuuauagugucuuagagaagcuuuucugacauugagaugguaggggaaauagugugugauguguggcuagcagugccaggcucagcaaggacaguggacuuggggauuuggucuuuguccugugugucugccucacuccagcagggcggggcaggaccagagcugaagggagccuagugacagcucagccuucccguauacuuuaccccucuguuucuaccugaagagcaaggguuucagaagaaggggcaugacacuucuacccucagaauaaaaguucccaaagguagagauaaggguuuuguuuuuugguuuuucgagaggcuuuuguuuuuuaauuuaaaagauguauuaauauuuuuuuaauuuuuaaaguguguguguguguaugugugugucugugugugucuuuauagggauaugugagugcagauguuuaaggaggcagugaugugucagauccuucuggaguuguauuacagaccauuauaagcagccugauguaaguucugggaauugaacucugguccucuguaagagcaguacuuaacagcugagccaucucuagcuccuuguuuuuguugucaugagacaaucucaaacuauaaccuaggcuggcccugaacucagggcaguccuucugucucagcuucuguaguguuaggauuacagaucuuaaaccauggugauagggaaagucaaguuuugaagauugaauuauucaagcucauuaaguacucuaguggccaucuugacucuuuguccaaaguauggcugaauguaccauuaacauugaguuucaguagaacaguacccugccaauuguagcugguuugaggaagagcuuauuuuaugaaagcaccaugaacuagcuguugguuguuccaguucccuuuuucuuuagugggccuuuaguaguaugccagguccagauccauuggccucacaggcaggggguugugugugugugguguuuucugggcaugggggaagcucauaaagagauaaucuggcaaagcuguauuacuuugauuugccuuucaacaaaaauuaaugcucuucuggguccuccugcuucuccugaggccagggauggugguguuauauguggguaugugauacuuggcauggcuuugugcauacuaugcccucuguaaagaccaguggagcagggguggccauugagaagccacagccacuuggagguucagccucauugcuucagcaggagcccucaaugguuagagaaugugcauguuagccaacauggaugugaaucugaagauguaagaucaggguaugaccuuaggucauuucuccucaauuccauucugugaccaaaauaaguugcaucuguuuauagccagguggaauugucuccuauauacaaauuguaugcuccauauauguguucaggaaaggaguaaagggcuagggucugggguuacagccaaccuggcucuuucaaggagucaggauagagacuuccuuagaagcaccagacuuauccuaggcuggcagucaugugaucaugucgauugacaugaagacagaacaaguggcuacagggucacuagggagggccaggcugagccuuguccccugauuucaggacgguuguguugucauacugugcuuuucuccauuuuagauguguuucuugguugaugccuguguauguuucuugcuuuguuuugucuaugguuugggggagcaaaccuagugcucugcugcuguuuccaguucuguaucuauaguuuuggaguuuuuccagugagauggaguagaggcucucuguacuuccugccaacguagaaauacgguagcaguguauguuaggacaguguuucucagcuuaucuauugcuuugcccuucuguucccuuuccucauguugugacccccaaccauaaaauuacuucauugcuacuucauaacuauaauuuuguuacuauugugaauugcaggauaucugauaccugacccccuaaagugcuugaaacccacagguugagaacuacuguguuugggugugguucuguggcuccuagguaggugcuguaggcauguagugcugcaggaagcuccagaaugugcaauuauucuggaagcccugacuccaguuacaaguccagauucuguuccugagaggaagacaagacacagaacaguagguaucugcuuuaagaagauuuacacaaacaauguggcaagauguauccccauuggagccuuuagaaguuucaaaaauuguuucaugaauuccuuauuguagcucuacuacaggugauaugguagcucaguuauuugcuuagagcugcugauguauagaguuaauguggcugugaauguguuucaccuuuuugagacuaguuauguuaagaaaugguaaugcuuaaaaauaaagggaagacaggcagugguggugcacaccuuuagucccagcacuugggagacagaggcaggcagauuucugaguucgaggccaucuuggucuacagagugaguuccagacagccagggcuacacagauaaacccugucucggaaaaaaagcaaugaaugaaugaaugaaugaauaaauaaaugaauaaauggagaaacaauauaaagaugagguucagcauuuuaguugcuguaguucaaaaacuuaagaguuuuaacuugaguauggguauagaccuugauuuguguguguguguugggggggguuucaccuuaaguuugcaaagaaugcucuaauuucaauuucacucaucauccuaccuacaauucagaccugguguguuuccccugcccugaagaagcuucgaggaggcagugugcaacuguugauugagucacaguuuugcccuuccaagagugcuugccugucuuaguaucagcacauucaauuuuacucuuaagcaaauuuuaugaaauaacgacaaaauguagagcaguacuuggauugcauggacauacuuagaagccuggaauguucagcugaggggcaugugaagaccugcggcuuuagcaacagacauucucagucucuguuaauguacaaaaagcaguguguacagaggucaacauguggucauguuguacaugacacuaaagccccuuuaaaguugcagguuuucauguauuuuauuuuugaacacugguacucuuuacuaaaaacuuuaguuagaaaguguuuuauacuguguucaaguucuuuaagaaaaguuuuaaaauugguaaguuuccucaaaugugauaacugagaauauacccuugauggauguggcuaaacuuuauuuuugaggcagaucuccuguagcucuggcuccaguguuuuaguguugucccuguaugcaguuccugcagaggccagaagagggcuucacauccccuggaacuggauggaguuaaggacaguuguaagcugccaugugggugcugggaauggaacuguguccuuugcaaaagcagcaaguacucuuacccauugagccaucuuucuaguucccuaaaaggaacucuuaagacagcaccaauuuuucauucagguaguaaguaugaguccuagucagggcagaacauucuguugagucugcagcccagagcagaaaacuucucuuucuacugggauucuuucaaaauagugguaauaauuggaggaaaauggcaaaccuacacaguccgauuuaaagaagguugucuggccuuuucugagucuuguggaaggaugauugacuuccccuggcuaucgcuuggcugcugcucaggccccuguucaacuacuaaaccagucagguugcauucauuauuguggaauagguguggacucaguuguguuuucucgccuuuacuuaagagaccaggaagagggucuguacagagggugguguagggagugugguugccagaggagaagcuacuucaaccauuguccucuccuccccaaagaaugaacuuucuugacccccaacuaacuuggugguuguggguccuccugccugaggcacucccucugguaguuugguaggcagaauaaaccagcaagaggcucucugggaaaguuguuuucacugccugcugauggagugaguaaugcagaagaaccggaaaagcaaguuuagcuugugugugggauugaagagggaaggugacagcaacuugacuuggcuucaagcagucagugccuguacccagagucucuggugaugauuggcccuuguagccacuaggcuuuucucucuguggaggcuccuuuggguuugggucuguucuagaagcagugguuggggcccuaugaggacaaagaagugccugugugaacaguaggguggaucuacaugcuugcauuguugaaugucuuaaaucuggaacucaucauugaauucuauuuccuucuuccuaggugauucuuguuaaaaagaaagaaaauguucacugugguuaucauggccuuuccauagagaaggcagguuaggcccagcacacucagcugugggcugugcagaucacaugcaagaaagcagcacugaauaacaguaguccuggacaaugagacacucaugcaggcaaacuuggcugagguccccgccacuagacacaguuauucaaggugucugucugcuacuguagggacuugagaggggugcacauauccucuccccuuaaucuuccucuggauuuuuugggggggggguccugcuuuuccuuuugaaacagggucuuacguaguucagacuguccuucaacccccuacucauagccaaggaucuuaaacucugccucaaccuuacuggggucauauauuugcucauacauggauagugagcacaacaacuauuguuuucuucacagcaucugaacauaaagagcuaucuuaauguccccucugccuuaccaagccccccuggcacacugguggcacccuagucaccucugguggaucccuuuuguuucuccauugguaacuuuuuuuuuuuuuuuuuuccgagacagaguuucucuguguagcucuggcuguccuggaacucacucuguagaucaggcuggccucgaacucagaaauucaccugucucugccucccaagugcugggauuaaaggcgugcaccauuuuugauguguugauuuagaaggacaacugauugcugagcagauaguuaagcuguaucuguggagcuuuuuuguuuaaaauaaauuauguguauugccuccuugguccuccccucccccauacuugagugcuuccugcucucuggcaucuucuuaauucaucuugggcucacuuucuuuugccugguuuggauccucaugggaagccuugucauguugaaauuguuuuuaacuaucuauaauugguaggaauuaaagguugagagccauaaucucagaauuuuuaaagagcguugccugagagucuuccucccaccagcacugacugcauugucauugucacagaguguuuuggcaguaggcagcagcucuuagagcaugugcucccucugccuagcuaagagucucccucuguaguuauucuugucaaucuguccuguccaucuguuuucuuucucuucucauuuccuuccacuuuccucucccgucgucuugucuucauguucuuccuccuuuguuugguaguugguuuuguuucuuaguuuuuccuagguaaggucucagacucuggcuggaaucugcuagccccagugcugggauucuaggcaugacucaacaucuagauuucuuccuccuuuuucuuugacagucucacuauauguuccagauuagccucauacuuucugucaucguguucauauuuuuccuauucugcuuucugugagccuucauuuugaacuuuucgugucccucauuuucuuuuguuccaguauccuguucuugguggaccucuguacugauacauucaggcuuugggguguucuauuguuguugaggcagggucucacuaucucccucaaguuacuugggacuuauuuuuuaaaccauccuggccuugaccucagagagcuaccuaccucugacuccugguuggugggauuaaaggcaugaaauaccguaucucacacuguuuuugaggucucuuguagcuuaggcuggccucaaaauugcgaguagcugaggcagaacuucuggucuuccugccucuaucuaccuagugcuggguuuacacgcaugcacaucauacccuguuuauguaguguuggggauugaacuugggauuucauggaugcucugccaacugagcuccaucccuacccugaguuguuuguuuguuugauuuuuuugugguggcuuuucuuuuuaagauuuguuuauuuagguauaugagugcucuacuugcacguaugccugcauaacagaagaaggcaucagaucucauuacagaugguugugagccaccaugugggugcugggaauugaacucagguccucuggaagagcagucagugcucuuaacuucugggcugucucucuagcccuggugacuugguuucuaaguagucucucuccuguuuuggcuugcuuccagucaaaaaggcucccuuuuugcuuuuuggaaucaaaaaggcuuuuagagaggcuuuuaaagagagauggagcuaggcuuugaggagcugcuucuguucauaucuucuggggcauucugagagugccccauaucucuguccugugguucaacugcucuuacacaccaugaggggcugaagguacucacggcuggauccuauccaugaccacugucccagggacuccaguuguucacuuguuugggguuuagucacuguggcuucuguacuguugaacccauccugggauuuuucugggaacuuuuugaggaaggaguacuuaagaagugaaguggugacacacaccuguaauuccagaacucggauguagaggcagguggaucucuguaaguucaaggcuagccuguucuauagaagaaguugaguucuaggauaacuaagguaacacagagaaaucugucucaaaaaaacaaaacaaaacaaaaagcaacaaaaaaugaaguagaaggccuuuagugcuaaaguaucauugcucugucuuagcugauaaagugaagaauugaguguguaauccucaacaucuccuuuuucucucuccuaauauuuuuauucccauauggguagucauuuuggggagugcagaauguucaucugcuuaaacauaagcaucauauuguauaacuuuugauuacauuaccuaagaagaggacauugucuagaggguacuagagauggugugaagggguccuguaggccaugucucagacauggugccaucacaucaguccacugaacaagacaguguaauguguaacuugcggggguaucccccaaaaugaaggauuuucuuuguagagccugcuuaacuggcuaguggaagugacuguguuaaaaagucaacuguuugcacaauguaauaagagguuacagaacugagccccgaaaaaugguguaugaaguccuccacauaaugccccuuaacacaccugcacgugaaaaggggaggccacaugguccugucuauaguccauguuauaguacuacuaauccuuuguguuucacauacuaugauuugaaugcacuuuccaaagugaaguuauaugggaaauugaaccccaguguaauaacguugggcaaguguuugguucuuaaaguuccagccucaagaauggauaauggccaucaggaggaggacuuugcaaguucacacucacuuugcuacaugagauuauggcauuccucuccugaaggauacggcugaagaccucaccuuagagucagacauccaaccugccagaccaugauuuggaugucuacuguaucuguuguugccaaguugcccacuguaugauguucuguuaagguagcacuacgagacaauuuauagggaaacuuugucauucuuuuuccuaugggucaguagccuuggauaauaccuaggauugacaacucuuucugaaggcacuguggccuucuauuugcuuuucuuauuaagaguuaacaaugagcauuugacaaagcaagcaguaaauccauuuggaugagaagugaagaucaaaguggccaccagauguugagaccagaccuagggaaaccuuacuauccuucccagaagcucuuaacauuugauaggcccugguacauugguaccaacuaaauugccuagcguuucuuuucuuccagugggccuuaccuacuaaguaugcauaggcccuugcagggacacagcucacauuugccugucauccucuuauaggaaugugcugccaaugguuuacuguuugagucucuuucuucuugcgacuugagauagaacacugucuuaacaucugucucccaugaccugggcagacagaaaugccuggagagauggcaucacaguucuuaugggcuugucuagucucgcugucaccaggggcugguagaacauuuggcuuguaguguugagcauagagugugacuauuucuuuaguugaaaauuguggauacuuugacacuuugaaguaagaauagagauguaaggugguuuuuucugauuuugugaagagcucuguuagguuuuaagaggcccugugucagccaggcagugguggugcaugccuuuaaucccagcacuugggaggcagaggcagguggauuucugaguuccaggacagccagggcuauacagagaaacccugucuuaaaaaaccaaaaaccaaaacaaaccccaaaaaaggcccuuucucucaaaacucuuuuuagugccagcucccgagugugagcauacuugauuguaguuagaugucccuucauucugacaagugauuagacuugggagacaagggguuguugugguaucugcgucuuccuaaacugauaugugugaccuuggugagcguagggagucuggugggcagggggcaggguucuuugcugccaccugggaccuaggauugaauugucucccauccucccaugaaauuucaggagggauaugaggacauggcuuagggcaggggacuccuacauaggugucucugaccugccacagggcccacacuggcagcacauaacaguacuugaaccacuuuucuuucccaggucuuuggccaguaucgauuccaccuguccacaaacauggggaauaucuuugcaaaccucuucaagggccuuuuuggcaaaaaagaaaugcgcauucucauggugggccuggaugcugcagggaagacaacaauucuauacaaacuuaagcugggcgaaauugugaccaccauucccaccauuggugagaagcugggcccagggccaggguggggguuggguguggggauccaaaauacagaggcccucagcugcaguccugccccccagguuucaauguggagacuguugaauacaagaauaucagcuucaccgugugggaugugggcggccaggacaagauccggccgcuguggcgccacuacuuccagaacacccaagguaagcagccaguccuuguccuagauuccucauauuugccucaaagggauacaguugguucacugagccuuguggucuuugccauuucagggcaugaagccacaccaaacaucacggccaguggaaggacuggaucuagaaccuguggggucugguggggaguguucaguaugugcacuaauguggccauguuucaggcuugaucuucguaguggacagcaaugacagagagcgugugaacgaggcccgugaagagcucaugaggaugcuagcugaagaugagcuccgagaugcuguucucuugguguuugccaacaagcagguaggcaccagcaagguccuucccugaaggaaaaccuguaucagggaagaaagaggaggggugaaaggcuacccaggguuauuggcuguuuguggucccugccacuaauucuuccuuuuccucaggaccuccccaaugccaugaaugcggccgaaaucacagacaagcuggggcugcacucucuacgccacaggaacugguacauucaggccaccugugccaccagcggggacgggcucuaugaaggacuagauuggcugucuaaucagcuccggaaccagaagugaaccagaccccucccucccccucacuuccucuucuccgcccucagcuuuccucucauguggcaaacgugcgacucugugguccugagugccagaagcugucuccauggguuggucacagugugcaucgcaccgugcuguacaugugcagacgcagccugcagccagguuuuuauuuaauguaaauaguuucuguuuccacugaggcaguuucugguacuccuaugcaauauuacuuagcuuuuuuauuguaaaaagagaaucaacucaacugucaguacugagaagggauuuggguguaggggcaccuggccuccgggagccauugggcuguagacuggugucgguauccauuuggugguugguuuuuaacccaaacucagugcauuuuuuaaaaauaguuaaaaauacaggacaagaacacuugaacacacagaacggagacuaugccuaguguagguuuugcaguuaauggccugaaugcuagauaucagaucaccuguuucgcugugggaacaggagagaaggugaugaacaaaccaccauccgcugcauggucacaguagagcccccgugacucgccugucuuugggucaccugcauuccauagcauugugcuuguacuugugcucacacgguuaccuaggguaggcugggagccauuguggggugcagggccuggcuuguacuuggugugugcaaggcccaauggcagccugcauacccagccuacucuugggcccacuuggacgcgcuggcaggaggccugggucucaccagcaggagugcgugcaaggugggagggucgguccauuacagacccacauccuggagcacccccaucuccaugugugaaguagcuuccucccucagccugcaaggguccgauuugccaucgaaagacgaccucuacuuuuuucuuuuguauuuugauaaacacugaagaagcuggagcuguuaaauuuaucuuggggaaaucucagaacugguuuauuuggugucguggaaccucuuaccgcuuucaauacacaauuaguaaucaacuguuuuguauacuuguuuucaguuuucauuucgacaagcacuguaauuauagcuguuagaauaaagucucuuaacuauuuga

SEQ ID NO: 12474 - RNA, 14348 nt, Mus musculus
cgguggcggaggcgggcgcaagaugaugaaguuucgguuccggcggcagggcgccgacccgcagcgcgagaagcuuaagcaggagcucuucgccuuccacaaggugcggcggcgggggcgccggcggcucaggcgggccacaucgggccgccucugcccugcgagcgccgcgcugcucgggugugccugguuggggugucgggcugcgccccgcgccgugccgugcgcuuucgggcuccuggucucugaaccccugauaucucucccggugucccuugggcucagugggguccuccgaccuaucugccuuucgcucuuggccucuuuucuuucauuuuugguguguagcccggcucggcugagggacauucagggccagguuuuguuuucuuuaacucuuaggcgggcgagagagggaaaaguggggggugggggggcugggaaaucccugcgccuccacuuuucucaccaggcucugcccuaccuuggggucccuaguucaagggaugugcuggucuguaugcucaacugcauuucaaaccuuagugccucaguuucccccgccaugaaaugaggccaguuucccccuuguggauucuggauguccuugcgacccggccaguuccugaccuuacuaaaguuggagagacgagauacagaagagacccgggaaaggccucagcucccaccuagucugcacugaccaguauagagccccacaagccuaacucuuaucuguacugguggggcucugauuagauguuacuuuuaucccagagccugugugcaucuugcuguugaggauucgauuucucauuuccauuacacacguuaaaaaacaaacaaacaaacaaaaaaaaaaaaacugagguucaguagggagagggccgcuuaucuuuccuugccuugcugugugauagcaguggaguaggaguuuugaagcagcugcuacuguccugaguagaacuuagggacccuggacuucucuuaggaggcacuuucagggggagacccugccauggcucaguuuuuucuuguugcgaucucagcaaugaucagggggugccaggcuuuacagacaccauaacuaaagagcugccaggagaggcuucucagaugggagccucuuuuuggcucaccgugagggugugccccaugaaacaagaagagaguggguuuuagccagugaaugggguguguaguggggaccuccacaguugugaugagucucugaagcauggcuuccccugacugaugaugcuacaguggguaggaguugaggagggugaggcccgauuugagugggaagcaaugauaggagauaggucaucuuggggaacgaguuugauugccacaggggguguuaggagaucucuagagaauagugagccccagauucuugaguuuggacuuguaguccagggugaccaguggguauuggguuuaaauccagcucagaccacaaauuacaaauugccuguaggaugugcaucuccuacuaguuuaauuuggaucccuaccuccuugguaccagggcauggcggacaauucuucauugaaggggugguuuauucccugggaaaggaugcggacaaaaaagccaaaacagaagggcagaauauauaguaguucacaggguuggcuagagcuguggauaaaauauggugugaugagggugugggaauauggacugggaugcugacguaggcgggaccaguuagggaggccuuucagagcuggucauuugggagugccagguaaccugcacaguguggucgggggggggggggugcgggggggggaacagaaggaaugcagaggaugccaaagcuuuagucagcugccuagccaaagagccaagugcuuuggggugggagucaggugaacugggaugcccagagaaggaccacauggugaggccuaggcuuuggcuguggaucagaaggcaucuccuggagggccccaaguagaggagguaggacuggcuggcugguuuccaccggugacugagcacugguccaggcaggcauugggugggccuggagcagggugugggaaggguuacuuuugugagucuuagaaguaagacaguagagcucagggauugauuggaguuggggugcaaaggguaggcacuagauagggaucuagccucuuccauaaaacgagucugguggugcccacuaaggacuguggggacuuaccgugcugucguguucuggugucucuuggacacggaacgcuaagccuggggcuaacuagaggaagucaggucuagacagggcauggcaguucugugggaaagggaauucccgagccaacugccgugguuggucgguugguugguggcccugaucucuuggauggcuugcugucacugcuaaguguaagcaggcuggauggaguacugugaucagcccaagacugcuuguguagacccugccaccccaccucucccuccccgauggcuagcuccauguagauggccucuuuuauuuauguauuuauuucugagacgucaucacaucaugugguccaugcuguccucuaucuugggauccuccugucuuagcguuccaaaugcuaugauuauagccaugugcuaccaguccauauuugacaccucaugaagguauucaugucccaaccacacuugugcaugggugggccagugggaagaggcacagucacaccaaaggaaggaguacguauuggaacuuaguguauagggaaggaccuggccucacaaagagcggagaagcagguagguagcaccagcaucgacauggacaauacucaggucccaggugcuauccccaccucugauggugcugggauuccuguuuuccggcucuccguguggggagguggacagcaccuucugggccaauuagaagcagaagccccaggguauuuugcccauagaacccuuucuucccucauagacuguggagcauggcuuccccaaucagcccagcgccuuggccuucgauccugagcuccgcaucauggccaucggcaccagaucuggggccgucaagauguauccuuugcuucugaggugcugcucacuucaugcuggagucuuagcauggcaggugcuucauggagacagcugugcuuguuggggcuucugaagaggucgcugugccugugugccugugaugacuccuuucggaaaugagagggucuuuugguugggagaugggugauuggaggggaggucgguuugcaguaacaauggcugucccuugcugccuuucagccuaccaauucuuagguaauccuaccaucaucuuggcagcugugacuggggcaguuagggguggccugugagcccugaugagagaaagaguacauguguacacacacacacacacacacacacacacacaaauacgaagaccccauguguucaacccagggcgggagggcagugccaggcucagcauggugagcgcaacacugcccccaucuggacaccgaugccauacaaugggcugagugagcuguacaaugcaggcauuuuccuguaguccaggguggggguggggcaacaggcugcugaaugucuccuuacucuggaaauagcacccuaaccugccuucaggaaaacuugaggugcagagucuggcuagaagcagcuugguaaaggugccccuccaccugcucaccaagagcuggagcacuagguuggggugggaauguggcucgugguuuaugagguaaugucccuugucagggaguguggcuggaggggauguccuucccucuguugugggccacuggguguuuggugggacaguuaccaagaugagugcugcuugccauucgaagacccguggaugcuaugcugcuacuccacuugcugugaccuuguacuggguuagagguauccacaucaaagguguccauaucagaguugcccauggucuacacugccaggugcuuagagcuguccuuguggguauugcccucgugcuuaguauacaugaggaagccaaagcuagauccuccuucucuucccuuuuuccucucaauuccuguagccaugaacuccugagguugggaaacugaggcuggaaagugccacaguuggucucuagagccucccuucccccugcagggcagucucaucucccaggagacugugcuuccugccagcugccccuguccucucuuugucauccuugccagccucuucagggagucccagcucaauauccaggcaacugcuccuuccuugucacugggacaacaucacugacccaucucuuagcucucuugggcccuuucagcuuugcuggccuccaucaguccuggaguuucugggucucggggcacuuguucaaacaggucucccgucuucuagucugugcucaucuggaagcugaguaguggaagcuguuggcuaccugcucugaagggagcuugggguucuugaccauggucaagaguuguuugaucuggcacugcucuguucugcuuaggcccguuaaccucuacugcaaggcgcuugguccgugcaggugaauccgcggccucguguguaccaugccggagccacagugcugagcaggugauuagucuuauuccauuggcaccagcuuucugguuugagucauuggccugcuguacagaugagggcuugaaaaccuauaucaguacccuacugggggcgcuguguggguucugugggcaccucagauacaggagcagaguugcuuuaggaagugggggucaucaggagacugccggacuccuggaugggcagagccugucugacuguccuagcuugucugcacguuuguucuugacaaguuaccuuagcuauggugcacccggaguggaauuuacaggccuacaucgggacgcagccaccgucacccagaugcauuuccucccuggucaggugaauagcuccccuccuuuacuagcaccagguggucccacccccgugcucuccuccccuucaggcuacccccauuuuggucucugcuccgucccaucagggccgccuccugacccugcuagaugacagcagcuugcaucucugggagaucauccaucauaauggcugcgcccaccuggaggaaggccucagcuuccacccacccagcagacccaguuuugacaaugccagguacuggaggaucaggcugggacuagccacugggcagaggaauuagagagggccuaugagccugcucugcugaagcagugcagacacaguugggcucugcuucaggagcccugccuggauagaacccuucuugaagugguauccuuugaagauaggguuagagguguggccagcugagacugaggccagugggcagagacuguguuucccaccgugggagccuuuaguuuugggggucccagugaauagaauguuauauacccaacuccuuagaccuuuaggcuggcacaguacccucuagggauuugggacaguucuaugccaagguaauaucagcaaagucucaggcuggccuugaauuuuuagugauccuccagccucagucuuccaaguguaggguuacugguguguacccccauauuugaccuuccugcugguuucuugaguugggaucggcugggccaugguugauagucgggaggguucuccaggguaggcuuggugaggugcuggcuggaugccuggcugugcauagcaggccgggcuccccagguggagagccuugcccucaggugugcuggaaauagcugcaaugggauagacuuugcccacagguuaguuuuuccuggccuggccuggucacuguuugggccccugaugucugagguaucuggaaagcugguauuggggacccuggcuggggcagugcucugauucugccugagagaagcaggguaguaagugaucugugagucuuuugggaccuggagaacuuauuuuuaucccuuucuuugcuggcaugcugggggauaauugaguaggcuaauuacacugcacauagccuucccagggugucagccugugcugugaacaggcccugugaaugcagagaggcauaagagagcccauagaaaggguucaaccuguucugccuuccccagcagguagaugggcucaccuuacucucucuuccucuuuccugcaguuucccugccagucuaacacgugucacugugguccugcucguagcuggcaauacagcagcccugggaacugagagugguagcauauucuuccuggauguagccacccuggcacugcuggaggggcagacucucagcccagaugugguucugcgcaggugagcagcaggcaggaggacccucccauuucugggaaguucuccugacucucuggggcacucucugcagugugccagaugauuaccgguguggaaaggccuugggcccuguggagucacuccagggacaucugcaagaccccagcaagauccucauaggcuacagucgggguuuacuggucaucuggagccaggccacacagucuguggacaacguuuuccuagguaaccagguaagcaaacgaggcccgaaugcuccucuuccaggcccuuguccacaccugcuggcucaugccauccuauccucauccauagcagcuggagagccuguguuggggccgugauggcagcagcauuaucagcucacacagugauggcagcuaugccaucugguccacagacacuggcagccccccaacgcugcagcccacuguagugaccacacccuacggugagcacuggggaggcuugagcugaggguggggacuagggggccagcuggccuugaggguacuacauagccaaaucuacagaaggagccuccggggggcaucgcuggguaugggccguaccuuggggagaggcacaagggugaggaaugggaggucugacacucuccccacccccaggccccuuccccugcaaggccaucaacaagauucuguggcggagcugugagucaggguagguagaggggcagugugggaggggcuugucuggcuggggacuagaggauuaggcuccggguauauaggggugcagcccuuacuggguuauccagcaugugcccugcacucccggagcuccugguucacacagccucccuccccuugcagagaccacuuuaucaucuucagugguggcaugccucgagccagcuauggugaccgccacugugugaguguacugcgagcagagacacuggugacccuggacuucaccucucgugucauugacuucuucacggugcacagcacacagccagaggauggugaguaucccaccucucucacccccagcuagcccaguguggcuguaagcugagcucacucgcccaacuccacagagugugacaacccccaggccuuagccgugcuucuggaggaggagcugguggugcuggaccugcagacaccaggcuggccagcugugcccgccccuuaccuggccccacugcauucgucagcuaucaccugcucugcccauguugccaauguccccagcaagcugugggcccgcauuguaagugcuggugagcagcagagcccacagccugccuccagugccuuggugagugugggugucuugugucccgggagggguggugaggugggagcuguucugguggaggguguagucuagcccagacgggagauggguaugcgggaggcauguggccaggaugagagagagaccuucagccuaacuuuaagcuccugucuuuguugucuuucuuagaguuggcccauuaccgggggccggaacuuggcccaggaacccucgcagcgugggcugcugcucacuggguagguauggguggcagacagggcccagcaccuaggaggccuuauuuguuuucugagcaucccagauucuuugggugcugaagugcucagugacucagucucaguccuagugaauccgaucugaguuguuccuguuaggaagccucccuugauucuggcucaaagcccuccucuccacuuccucuuggccugggacugaguuccagcccagcccagcccaggcuccacccaccuggcuugccugccauggacuggaaaaucuggguuggccucugcugacucuaccagucaggugcuggaaacgccaggcuaggucagggcacuggugacucaggccucacuaacugcccugcccucccuccugccugucugggacccucaggccucucaaggcagcucgcccuuuccuguugggagcuggcucuagccucagggaugcuggggagccugaaccaccucguucucuaguuccuuucugacugacuugggagcccaguggggcucugcagcuugucccagugcuucaccuuacuuuugucuccuccucuuccucucccuacuuucuccucguuugacacccagccuuuccauugcuuaccugcaaggcacccuuaggcuucuugccugaccugggguuuguggcaugugcuaugauuucuggguacccauugcuccucucugccaauuccugguugucaaaguggucauuccuuuaccuuccaaccuguucagaaggcucucggggcaugagauuguguguagccugaguaccuauucuuccugcauugugggugcuuacugcugugugcaguagguaccuguaguggccacuggaagaauaauugagagggcguggaucucccggggcaggcucugacacucaccuucucuacagccaugaggauggcacugugcgguucugggacgccucugguguggcgcuaaggccacucuacaaacugagcacagcuggccucuuccagacggacugugaacaugcugacagccuggcccaggcuguggaggaugacuggccgcccuuccgcaaggugccucuccucccucccccugccccucagggccggccuuugagcuggucauagcucugcacugcaucaccaucccgucuuaucccuucaggugggcugcuuugaucccuacagugaugacccccggcuaggaauccagaagguugcgcuuugcaaguacacagcccagauggugguagcuggcacugcaggccaggugcgguuggccugcagucuccagaugugguuggccugcggucuccagauguggcuauuggggaggcuuucugcaggagguggcccuguaggguguggugaaguagagggcaaccaaugugggcgguaggucagagugggaacggaacaccagggaagguuggcaggggugaggacagaugcaaaguguggggugccaucacaguguggggugccaugacuugaguaaggguaggggaagcacagaggcuugaggcugggagcagaaauauagcugugcagauguguucugcaacugcagggccuagcgggucuguaacagaguaccugugcacugacugcacucggggccuagugucuagucauugcucaguagaaggcagacucaggaaggaguuacagacuccaggagggcagaggccagcauguuaggaggucaccacagcucagugaaggcuuugguacauuguagguauucaggggccauuugcuggguaggugaguucuggggccacucagccucucuccugcuguguguccaggugcuggugcuggagcucagugaggucccagcagagcaugccgucaguguggccaacguggaucuucuucaggaucgcgagggcuucacguggaagggucacgagcggcugaacccacacacggggcugcugccguggccugccggauuccagccccgcaugcugauacagugccucccacccgccgcugucacugcugucacacuccaugcugaguggagccucguggccuuugguaccagucauggcuuuggccuuuuugacuaccagcgcaagagcccugugcuggcuagguauguggcacgagguggccaggugggugggcagccagagcccugagaagguggucugggauuccguuuccuuucagagguugugcagaagcaggcugguugggaaagcccuuguaaacgcucuccuccugcgggagaacgggucagcucuuggagcugcugugggcacaagcccuagcuccgguugcucuggcccccaggagagcaggagugcaguguagcuccauagcacaguuggcccugucauccccaggugcacccuucaccccaaugauucuuuggccauggaggggccacugucacgggugaagucccucaagaagucacugagacagucauuccggcgaauccgcaagagccgugucucaggcaaaaaacggacuccugcugccaguagcaaggugaguuggggcuggcagccauguccgugcccugacccagagugcuccggucuggucaggugccgugggcccuguagggugaagggauccugcuggacacggggcagagggcucuuggaagagcacgucugagcgccucuggccucuggcccucccaguugcaggaggccaaugcccagcuggccgagcagaccugcccacacgaccuggagaugacacccgugcagcgccgcauugagccucggucugcugacgacucgcucuccgguguuguacgcugccucuacuuugcugacacguuccuucgagauggugaggccaggguagggacgagggucggagaggcuggaugaccucuguacuggggggaggcggugugagaagcagcuucuguaugcugagcuacacuuugggacgccauggcagccagccgccuguauagcacaucuaggagacauguuugcggguuuauagaguugaacagaagcaagggagccguggugaggcggacggugagggccaggauggcugaggcccugugguaggcaggaggcagaggucggggacagaucaggcagagcuggugcugccaucacucagggacucugugggagcacguccucucugugcuucauguuggcgguucuuugguuuuuacguuguaucauacuaaguauaaacaaaauaguguguagucccucauauacuugagcuaccaccccagugugucagcacacuucacucuuuuacuuuuguuuguguuuauugcuuguuuuuuagacagggacucaccacaugggccuucugccugauacuugcuauguaaaucauguuggccucaacucacagagaucugucucuaccuccugaggguuggcauugaaggagugugcuagcgugcccagccuugcaggaggcacugcguuugcuggaaugaguugaggguguagcguguugaguuggugguaucagguacuagguuguggcccugauacccccuugaagaugcccucaaggugacucgugccucuggaucugggcugguguuucugaccaguggguugaggccacacagcaaguguagacugggagggcgcacuggucccugcagccaguuaggaaaugaugguuacagugagggugagggagaagggucuguggggaauggacucucagaaggccuuccuacuuuacguguucuucacagcgacccaccacgggcccaccaugugggcgggcaccaacucgggcucuguguucgccuaugcgcuggagguuccagcagccacagcaggcggagagaagcggccugagcaggcaguggaggcggugcugggcaaggaggugcagcuaaugcaccgagcaccugugguggccauugcugugcuggauggucguggccggccacugccugagcccuaugaggcuucccgggaccuggcccaggcgccagacaugcaaggcggccaugcugugcucauugcaucugaggaacaauucaaggugagcugccuugggugaugaggauccauucaggcccucaagcacugggugcagucuagcccugccuuaguucccccuaaggccuucuaccucacagccuucuccuagagccgguggaaagcgcuugaaucuugguccgugagaguacuaggcauaggacaaaugcauauguccagugaucuggccaaggguggaaaugaggcucauggugaagccugggcuguucuguaggccaucugcuggauggcugguuaagugaguggccuuugauaugcacaguuggauugaggccugcagagccaggugggugucugcagcugaggaauuuugugguuaggacuaagcugggccugucugucugucaacagguguucacacuacccaaggugagugcuaagacuaaauucaagcuuacagcccaugaaggcugucgugugcggaagguagcccuggcuacauuugccagcgugaugucugaggacuaugccgagaccugccuugccugccucaccaaccugggugauguccacgucuucucggugccuggccugaggccucaggugcacuacuccuguauccggaaggaggacaucaguggcaucgcuuccugugucuucacacgucacggccagggugaggcgggcaggucggggaugagugguggguuacacagaaaacccgggccaccaaggguuggcgguggcagugucccuuaaauauuccuuggcccuuuucucccgcccacaggcuuuuacuugauuucuccaucggaauuugagcgcuucucacugagugcucgcaacaucacagaaccacuauguucucuggauauaagcuggccccaaaaugccacccagcccagguuugugaggaaugggucccuuagccgccuugggcccugcacuccccugguguuagugcccauuucuaguuugggggucagaugcagcaccuguaauagucuccaucacacucccaucuuuuucacaggcuucaagagucacccaagcugagccaggcuaaugggaccagagacaucauucuggccccagagagcugcgaaggaagcccuagcucugcccacagcaagcgagcuggugagagggcacagggguggggcaggcaggcauugaggguaccugagggagagggguuaagacguaagcucagguuccacugagccagggcuggagggcgccugugugugcacaugcguguccugugugcucugucguuaguaccuggucucuaggugcacaguagauacugagcagcacuucuuccaacagauaccauggaaccacccgaggccgcucucucgccuguguccauugauucagcugcuaguggggauaccaugcuggacacaacaggggaugucaccguggaauaugugaaggauuuucuggggugaggccagcugcucucccaagccgccauccccagggcaacuaggggucuucuuaccccagcccuucugauuacugcccuccccagcucuccugaggacucugagaagaaccugcggaaccuggaggcagaugaugcuugucgggccuacacccuucugauuaaaugaggugcuguggggcagccuggccuuaccacacagcagcugccaucccucacuccagcuggaacccugcaggcuucucuaauggugucauuccucgaagccuagcugccuuccucuggcugucaggcauaggggauccacagucaugaaagggccuggccuggcagcacugaaauccugugcauuuagaaggccaccucugacccuguggguguaggaguugaugcuuauccaguccacagagcccauuucacaggagagucacugaggcugauagguccugccuauugagccagcacauggaccuuaugugccccuaccguaucuugcuauggacccagccuagcuggagacuggagcucucuggaccuuaguagcuagugccucugcagccuacauugggcauagauaacuaaccauacccucuucuacuugguacccuccuagcuccccagcaagcccaucuugggccaucacugaaaggggcugccuaccccgcaggcaggcaugaccuggguuugcuccccuuagucgucaccaucugucggucuugccuugccccuuaacacggacccgcugacugaugcugggcccugaacacaucccagccucaagcucagccggaggggugcgagcauccuuuugcacuccauacuguacuuccuuucuccucaagcagaguauuuuucuaacgccuggacugagcuggccagucauuucuaaagcaguuuugguacuugcuccuggccuguguguauugugugcuccugugacuagagacugcugggcgucaugacugaagucagucagaggugugugugugcgugugugugcacgugugugugcggcagugaggaugggcuucccuguagaugccaccuucggcuuuucugucuuuuuuuaaaaacuaguuguuuuaauauuaaaaguacugauuuuuuaauauugaaaauaaaagcauuuaauaucuuuuaaacua

SEQ ID NO: 12475 - RNA, 14348 nt, Mus musculus
uaguuuaaaagauauuaaaugcuuuuauuuucaauauuaaaaaaucaguacuuuuaauauuaaaacaacuaguuuuuaaaaaaagacagaaaagccgaagguggcaucuacagggaagcccauccucacugccgcacacacacgugcacacacacgcacacacacaccucugacugacuucagucaugacgcccagcagucucuagucacaggagcacacaauacacacaggccaggagcaaguaccaaaacugcuuuagaaaugacuggccagcucaguccaggcguuagaaaaauacucugcuugaggagaaaggaaguacaguauggagugcaaaaggaugcucgcaccccuccggcugagcuugaggcugggauguguucagggcccagcaucagucagcggguccguguuaaggggcaaggcaagaccgacagauggugacgacuaaggggagcaaacccaggucaugccugccugcgggguaggcagccccuuucagugauggcccaagaugggcuugcuggggagcuaggaggguaccaaguagaagaggguaugguuaguuaucuaugcccaauguaggcugcagaggcacuagcuacuaagguccagagagcuccagucuccagcuaggcuggguccauagcaagauacgguaggggcacauaagguccaugugcuggcucaauaggcaggaccuaucagccucagugacucuccugugaaaugggcucuguggacuggauaagcaucaacuccuacacccacagggucagagguggccuucuaaaugcacaggauuucagugcugccaggccaggcccuuucaugacuguggauccccuaugccugacagccagaggaaggcagcuaggcuucgaggaaugacaccauuagagaagccugcaggguuccagcuggagugagggauggcagcugcugugugguaaggccaggcugccccacagcaccucauuuaaucagaaggguguaggcccgacaagcaucaucugccuccagguuccgcagguucuucucagaguccucaggagagcuggggagggcaguaaucagaagggcugggguaagaagaccccuaguugcccuggggauggcggcuugggagagcagcuggccucaccccagaaaauccuucacauauuccacggugacauccccuguuguguccagcaugguauccccacuagcagcugaaucaauggacacaggcgagagagcggccucgggugguuccaugguaucuguuggaagaagugcugcucaguaucuacugugcaccuagagaccagguacuaacgacagagcacacaggacacgcaugugcacacacaggcgcccuccagcccuggcucaguggaaccugagcuuacgucuuaaccccucucccucagguacccucaaugccugccugccccaccccugugcccucucaccagcucgcuugcugugggcagagcuagggcuuccuucgcagcucucuggggccagaaugaugucucuggucccauuagccuggcucagcuugggugacucuugaagccugugaaaaagaugggagugugauggagacuauuacaggugcugcaucugacccccaaacuagaaaugggcacuaacaccaggggagugcagggcccaaggcggcuaagggacccauuccucacaaaccugggcuggguggcauuuuggggccagcuuauauccagagaacauagugguucugugauguugcgagcacucagugagaagcgcucaaauuccgauggagaaaucaaguaaaagccugugggcgggagaaaagggccaaggaauauuuaagggacacugccaccgccaacccuugguggcccggguuuucuguguaacccaccacucauccccgaccugcccgccucacccuggccgugacgugugaagacacaggaagcgaugccacugauguccuccuuccggauacaggaguagugcaccugaggccucaggccaggcaccgagaagacguggacaucacccagguuggugaggcaggcaaggcaggucucggcauaguccucagacaucacgcuggcaaauguagccagggcuaccuuccgcacacgacagccuucaugggcuguaagcuugaauuuagucuuagcacucaccuuggguagugugaacaccuguugacagacagacaggcccagcuuaguccuaaccacaaaauuccucagcugcagacacccaccuggcucugcaggccucaauccaacugugcauaucaaaggccacucacuuaaccagccauccagcagauggccuacagaacagcccaggcuucaccaugagccucauuuccacccuuggccagaucacuggacauaugcauuuguccuaugccuaguacucucacggaccaagauucaagcgcuuuccaccggcucuaggagaaggcugugagguagaaggccuuagggggaacuaaggcagggcuagacugcacccagugcuugagggccugaauggauccucaucacccaaggcagcucaccuugaauuguuccucagaugcaaugagcacagcauggccgccuugcaugucuggcgccugggccaggucccgggaagccucauagggcucaggcaguggccggccacgaccauccagcacagcaauggccaccacaggugcucggugcauuagcugcaccuccuugcccagcaccgccuccacugccugcucaggccgcuucucuccgccugcuguggcugcuggaaccuccagcgcauaggcgaacacagagcccgaguuggugcccgcccacauggugggcccguggugggucgcugugaagaacacguaaaguaggaaggccuucugagaguccauuccccacagacccuucucccucacccucacuguaaccaucauuuccuaacuggcugcagggaccagugcgcccucccagucuacacuugcuguguggccucaacccacuggucagaaacaccagcccagauccagaggcacgagucaccuugagggcaucuucaaggggguaucagggccacaaccuaguaccugauaccaccaacucaacacgcuacacccucaacucauuccagcaaacgcagugccuccugcaaggcugggcacgcuagcacacuccuucaaugccaacccucaggagguagagacagaucucugugaguugaggccaacaugauuuacauagcaaguaucaggcagaaggcccauguggugagucccugucuaaaaaacaagcaauaaacacaaacaaaaguaaaagagugaagugugcugacacacuggggugguagcucaaguauaugagggacuacacacuauuuuguuuauacuuaguaugauacaacguaaaaaccaaagaaccgccaacaugaagcacagagaggacgugcucccacagagucccugagugauggcagcaccagcucugccugaucuguccccgaccucugccuccugccuaccacagggccucagccauccuggcccucaccguccgccucaccacggcucccuugcuucuguucaacucuauaaacccgcaaacaugucuccuagaugugcuauacaggcggcuggcugccauggcgucccaaaguguagcucagcauacagaagcugcuucucacaccgccuccccccaguacagaggucauccagccucuccgacccucgucccuacccuggccucaccaucucgaaggaacgugucagcaaaguagaggcagcguacaacaccggagagcgagucgucagcagaccgaggcucaaugcggcgcugcacgggugucaucuccaggucgugugggcaggucugcucggccagcugggcauuggccuccugcaacugggagggccagaggccagaggcgcucagacgugcucuuccaagagcccucugccccguguccagcaggaucccuucacccuacagggcccacggcaccugaccagaccggagcacucugggucagggcacggacauggcugccagccccaacucaccuugcuacuggcagcaggaguccguuuuuugccugagacacggcucuugcggauucgccggaaugacugucucagugacuucuugagggacuucacccgugacaguggccccuccauggccaaagaaucauuggggugaagggugcaccuggggaugacagggccaacugugcuauggagcuacacugcacuccugcucuccugggggccagagcaaccggagcuagggcuugugcccacagcagcuccaagagcugacccguucucccgcaggaggagagcguuuacaagggcuuucccaaccagccugcuucugcacaaccucugaaaggaaacggaaucccagaccaccuucucagggcucuggcugcccacccaccuggccaccucgugccacauaccuagccagcacagggcucuugcgcugguagucaaaaaggccaaagccaugacugguaccaaaggccacgaggcuccacucagcauggagugugacagcagugacagcggcgggugggaggcacuguaucagcaugcggggcuggaauccggcaggccacggcagcagccccguguguggguucagccgcucgugacccuuccacgugaagcccucgcgauccugaagaagauccacguuggccacacugacggcaugcucugcugggaccucacugagcuccagcaccagcaccuggacacacagcaggagagaggcugaguggccccagaacucaccuacccagcaaauggccccugaauaccuacaauguaccaaagccuucacugagcuguggugaccuccuaacaugcuggccucugcccuccuggagucuguaacuccuuccugagucugccuucuacugagcaaugacuagacacuaggccccgagugcagucagugcacagguacucuguuacagacccgcuaggcccugcaguugcagaacacaucugcacagcuauauuucugcucccagccucaagccucugugcuuccccuacccuuacucaagucauggcaccccacacugugauggcaccccacacuuugcaucuguccucaccccugccaaccuucccugguguuccguucccacucugaccuaccgcccacauugguugcccucuacuucaccacacccuacagggccaccuccugcagaaagccuccccaauagccacaucuggagaccgcaggccaaccacaucuggagacugcaggccaaccgcaccuggccugcagugccagcuaccaccaucugggcuguguacuugcaaagcgcaaccuucuggauuccuagccgggggucaucacuguagggaucaaagcagcccaccugaagggauaagacgggauggugaugcagugcagagcuaugaccagcucaaaggccggcccugaggggcagggggagggaggagaggcaccuugcggaagggcggccagucauccuccacagccugggccaggcugucagcauguucacaguccgucuggaagaggccagcugugcucaguuuguagaguggccuuagcgccacaccagaggcgucccagaaccgcacagugccauccucauggcuguagagaaggugagugucagagccugccccgggagauccacgcccucucaauuauucuuccaguggccacuacagguaccuacugcacacagcaguaagcacccacaaugcaggaagaauagguacucaggcuacacacaaucucaugccccgagagccuucugaacagguuggaagguaaaggaaugaccacuuugacaaccaggaauuggcagagaggagcaauggguacccagaaaucauagcacaugccacaaaccccaggucaggcaagaagccuaagggugccuugcagguaagcaauggaaaggcugggugucaaacgaggagaaaguagggagaggaagaggaggagacaaaaguaaggugaagcacugggacaagcugcagagccccacugggcucccaagucagucagaaaggaacuagagaacgaggugguucaggcuccccagcaucccugaggcuagagccagcucccaacaggaaagggcgagcugccuugagaggccugagggucccagacaggcaggagggagggcagggcaguuagugaggccugagucaccagugcccugaccuagccuggcguuuccagcaccugacugguagagucagcagaggccaacccagauuuuccaguccauggcaggcaagccagguggguggagccugggcugggcugggcuggaacucagucccaggccaagaggaaguggagaggagggcuuugagccagaaucaagggaggcuuccuaacaggaacaacucagaucggauucacuaggacugagacugagucacugagcacuucagcacccaaagaaucugggaugcucagaaaacaaauaaggccuccuaggugcugggcccugucugccacccauaccuacccagugagcagcagcccacgcugcgaggguuccugggccaaguuccggcccccgguaaugggccaacucuaagaaagacaacaaagacaggagcuuaaaguuaggcugaaggucucucucucauccuggccacaugccucccgcauacccaucucccgucugggcuagacuacacccuccaccagaacagcucccaccucaccaccccucccgggacacaagacacccacacucaccaaggcacuggaggcaggcugugggcucugcugcucaccagcacuuacaaugcgggcccacagcuugcuggggacauuggcaacaugggcagagcaggugauagcugacgaaugcaguggggccagguaaggggcgggcacagcuggccagccuggugucugcagguccagcaccaccagcuccuccuccagaagcacggcuaaggccuggggguugucacacucuguggaguugggcgagugagcucagcuuacagccacacugggcuagcugggggugagagaggugggauacucaccauccucuggcugugugcugugcaccgugaagaagucaaugacacgagaggugaaguccagggucaccagugucucugcucgcaguacacucacacaguggcggucaccauagcuggcucgaggcaugccaccacugaagaugauaaaguggucucugcaaggggagggaggcugugugaaccaggagcuccgggagugcagggcacaugcuggauaacccaguaagggcugcaccccuauauacccggagccuaauccucuaguccccagccagacaagccccucccacacugccccucuaccuacccugacucacagcuccgccacagaaucuuguugauggccuugcaggggaaggggccuggggguggggagagugucagaccucccauuccucacccuugugccucuccccaagguacggcccauacccagcgaugccccccggaggcuccuucuguagauuuggcuauguaguacccucaaggccagcuggcccccuaguccccacccucagcucaagccuccccagugcucaccguaggguguggucacuacagugggcugcagcguuggggggcugccagugucuguggaccagauggcauagcugccaucacugugugagcugauaaugcugcugccaucacggccccaacacaggcucuccagcugcuauggaugaggauaggauggcaugagccagcagguguggacaagggccuggaagaggagcauucgggccucguuugcuuaccugguuaccuaggaaaacguuguccacagacuguguggccuggcuccagaugaccaguaaaccccgacuguagccuaugaggaucuugcuggggucuugcagaugucccuggagugacuccacagggcccaaggccuuuccacaccgguaaucaucuggcacacugcagagagugccccagagagucaggagaacuucccagaaaugggaggguccuccugccugcugcucaccugcgcagaaccacaucugggcugagagucugccccuccagcagugccaggguggcuacauccaggaagaauaugcuaccacucucaguucccagggcugcuguauugccagcuacgagcaggaccacagugacacguguuagacuggcagggaaacugcaggaaagaggaagagagaguaaggugagcccaucuaccugcuggggaaggcagaacagguugaacccuuucuaugggcucucuuaugccucucugcauucacagggccuguucacagcacaggcugacacccugggaaggcuaugugcaguguaauuagccuacucaauuaucccccagcaugccagcaaagaaagggauaaaaauaaguucuccaggucccaaaagacucacagaucacuuacuacccugcuucucucaggcagaaucagagcacugccccagccaggguccccaauaccagcuuuccagauaccucagacaucaggggcccaaacagugaccaggccaggccaggaaaaacuaaccugugggcaaagucuaucccauugcagcuauuuccagcacaccugagggcaaggcucuccaccuggggagcccggccugcuaugcacagccaggcauccagccagcaccucaccaagccuacccuggagaacccucccgacuaucaaccauggcccagccgaucccaacucaagaaaccagcaggaaggucaaauauggggguacacaccaguaacccuacacuuggaagacugaggcuggaggaucacuaaaaauucaaggccagccugagacuuugcugauauuaccuuggcauagaacugucccaaaucccuagaggguacugugccagccuaaaggucuaaggaguuggguauauaacauucuauucacugggacccccaaaacuaaaggcucccacggugggaaacacagucucugcccacuggccucagucucagcuggccacaccucuaacccuaucuucaaaggauaccacuucaagaaggguucuauccaggcagggcuccugaagcagagcccaacugugucugcacugcuucagcagagcaggcucauaggcccucucuaauuccucugcccaguggcuagucccagccugauccuccaguaccuggcauugucaaaacugggucugcuggguggguggaagcugaggccuuccuccaggugggcgcagccauuaugauggaugaucucccagagaugcaagcugcugucaucuagcagggucaggaggcggcccugaugggacggagcagagaccaaaauggggguagccugaaggggaggagagcacgggggugggaccaccuggugcuaguaaaggaggggagcuauucaccugaccagggaggaaaugcaucugggugacgguggcugcgucccgauguaggccuguaaauuccacuccgggugcaccauagcuaagguaacuugucaagaacaaacgugcagacaagcuaggacagucagacaggcucugcccauccaggaguccggcagucuccugaugacccccacuuccuaaagcaacucugcuccuguaucugaggugcccacagaacccacacagcgcccccaguaggguacugauauagguuuucaagcccucaucuguacagcaggccaaugacucaaaccagaaagcuggugccaauggaauaagacuaaucaccugcucagcacuguggcuccggcaugguacacacgaggccgcggauucaccugcacggaccaagcgccuugcaguagagguuaacgggccuaagcagaacagagcagugccagaucaaacaacucuugaccauggucaagaaccccaagcucccuucagagcagguagccaacagcuuccacuacucagcuuccagaugagcacagacuagaagacgggagaccuguuugaacaagugccccgagacccagaaacuccaggacugauggaggccagcaaagcugaaagggcccaagagagcuaagagaugggucagugauguugucccagugacaaggaaggagcaguugccuggauauugagcugggacucccugaagaggcuggcaaggaugacaaagagaggacaggggcagcuggcaggaagcacagucuccugggagaugagacugcccugcagggggaagggaggcucuagagaccaacuguggcacuuuccagccucaguuucccaaccucaggaguucauggcuacaggaauugagaggaaaaagggaagagaaggaggaucuagcuuuggcuuccucauguauacuaagcacgagggcaauacccacaaggacagcucuaagcaccuggcaguguagaccaugggcaacucugauauggacaccuuugauguggauaccucuaacccaguacaaggucacagcaaguggaguagcagcauagcauccacgggucuucgaauggcaagcagcacucaucuugguaacugucccaccaaacacccaguggcccacaacagagggaaggacauccccuccagccacacucccugacaagggacauuaccucauaaaccacgagccacauucccaccccaaccuagugcuccagcucuuggugagcagguggaggggcaccuuuaccaagcugcuucuagccagacucugcaccucaaguuuuccugaaggcagguuagggugcuauuuccagaguaaggagacauucagcagccuguugccccacccccacccuggacuacaggaaaaugccugcauuguacagcucacucagcccauuguauggcaucgguguccagaugggggcaguguugcgcucaccaugcugagccuggcacugcccucccgcccuggguugaacacauggggucuucguauuuguguguguguguguguguguguguguguguacacauguacucuuucucucaucagggcucacaggccaccccuaacugccccagucacagcugccaagaugaugguaggauuaccuaagaauugguaggcugaaaggcagcaagggacagccauuguuacugcaaaccgaccuccccuccaaucacccaucucccaaccaaaagacccucucauuuccgaaaggagucaucacaggcacacaggcacagcgaccucuucagaagccccaacaagcacagcugucuccaugaagcaccugccaugcuaagacuccagcaugaagugagcagcaccucagaagcaaaggauacaucuugacggccccagaucuggugccgauggccaugaugcggagcucaggaucgaaggccaaggcgcugggcugauuggggaagccaugcuccacagucuaugagggaagaaaggguucuaugggcaaaauacccuggggcuucugcuucuaauuggcccagaaggugcuguccaccuccccacacggagagccggaaaacaggaaucccagcaccaucagagguggggauagcaccugggaccugaguauuguccaugucgaugcuggugcuaccuaccugcuucuccgcucuuugugaggccagguccuucccuauacacuaaguuccaauacguacuccuuccuuuggugugacugugccucuucccacuggcccacccaugcacaagugugguugggacaugaauaccuucaugaggugucaaauauggacugguagcacauggcuauaaucauagcauuuggaacgcuaagacaggaggaucccaagauagaggacagcauggaccacaugaugugaugacgucucagaaauaaauacauaaauaaaagaggccaucuacauggagcuagccaucggggagggagaggugggguggcagggucuacacaagcagucuugggcugaucacaguacuccauccagccugcuuacacuuagcagugacagcaagccauccaagagaucagggccaccaaccaaccgaccaaccacggcaguuggcucgggaauucccuuucccacagaacugccaugcccugucuagaccugacuuccucuaguuagccccaggcuuagcguuccguguccaagagacaccagaacacgacagcacgguaaguccccacaguccuuagugggcaccaccagacucguuuuauggaagaggcuagaucccuaucuagugccuacccuuugcaccccaacuccaaucaaucccugagcucuacugucuuacuucuaagacucacaaaaguaacccuucccacacccugcuccaggcccacccaaugccugccuggaccagugcucagucaccgguggaaaccagccagccaguccuaccuccucuacuuggggcccuccaggagaugccuucugauccacagccaaagccuaggccucaccaugugguccuucucugggcaucccaguucaccugacucccaccccaaagcacuuggcucuuuggcuaggcagcugacuaaagcuuuggcauccucugcauuccuucuguucccccccccgcacccccccccccccgaccacacugugcagguuaccuggcacucccaaaugaccagcucugaaaggccucccuaacuggucccgccuacgucagcaucccaguccauauucccacacccucaucacaccauauuuuauccacagcucuagccaacccugugaacuacuauauauucugcccuucuguuuuggcuuuuuuguccgcauccuuucccagggaauaaaccaccccuucaaugaagaauuguccgccaugcccugguaccaaggagguagggauccaaauuaaacuaguaggagaugcacauccuacaggcaauuuguaauuuguggucugagcuggauuuaaacccaauacccacuggucacccuggacuacaaguccaaacucaagaaucuggggcucacuauucucuagagaucuccuaacacccccuguggcaaucaaacucguuccccaagaugaccuaucuccuaucauugcuucccacucaaaucgggccucacccuccucaacuccuacccacuguagcaucaucagucaggggaagccaugcuucagagacucaucacaacuguggagguccccacuacacaccccauucacuggcuaaaacccacucucuucuuguuucauggggcacacccucacggugagccaaaaagaggcucccaucugagaagccucuccuggcagcucuuuaguuauggugucuguaaagccuggcacccccugaucauugcugagaucgcaacaagaaaaaacugagccauggcagggucucccccugaaagugccuccuaagagaaguccagggucccuaaguucuacucaggacaguagcagcugcuucaaaacuccuacuccacugcuaucacacagcaaggcaaggaaagauaagcggcccucucccuacugaaccucaguuuuuuuuuuuuuguuuguuuguuuguuuuuuaacguguguaauggaaaugagaaaucgaauccucaacagcaagaugcacacaggcucugggauaaaaguaacaucuaaucagagccccaccaguacagauaagaguuaggcuuguggggcucuauacuggucagugcagacuaggugggagcugaggccuuucccgggucucuucuguaucucgucucuccaacuuuaguaaggucaggaacuggccgggucgcaaggacauccagaauccacaagggggaaacuggccucauuucauggcgggggaaacugaggcacuaagguuugaaaugcaguugagcauacagaccagcacaucccuugaacuagggaccccaagguagggcagagccuggugagaaaaguggaggcgcagggauuucccagcccccccaccccccacuuuucccucucucgcccgccuaagaguuaaagaaaacaaaaccuggcccugaaugucccucagccgagccgggcuacacaccaaaaaugaaagaaaagaggccaagagcgaaaggcagauaggucggaggaccccacugagcccaagggacaccgggagagauaucagggguucagagaccaggagcccgaaagcgcacggcacggcgcggggcgcagcccgacaccccaaccaggcacacccgagcagcgcggcgcucgcagggcagaggcggcccgauguggcccgccugagccgccggcgcccccgccgccgcaccuuguggaaggcgaagagcuccugcuuaagcuucucgcgcugcgggucggcgcccugccgccggaaccgaaacuucaucaucuugcgcccgccuccgccaccg

SEQ ID NO: 12476 - RNA, 6021 nt, Mus musculus
caaaaacaugaaacauuuaagacuuuauuauaaaauguuguucuucauaauuuuucugaauuuaagacagacuaggcuauaccauguuucaaagaaaaauuguauuaaauggcuuauaauauuuuaaaaauaacauucaacauuugacaaauugaaaggaaucagacuagaggguuucuuaaaagucagugcauggguguuuugccugcauacauguauaccacauccaugccuagugucugcagaggcucgaaggccccagauuccccaggacuggguguuacagacaguggucgugagcaccauguagugcuagaauugaguucuagguuccugggaagagcagccagugcuuuuaacuaccgagccaucucuccagcacuaucuguguguuuguuguuuguuuguaacuucauguguuuggugugcauauaugugcaccacaggggugccuaauuuugccuguagaggucagaagagagaucagauccccuagaacuggagcuaggaauaguuuccaguucccaccccuucucagaacacauacacagacauacaaagaacacugaaaaaugacagggacaaaaaaccaaggagcaggcuaaagggcagagggaggcagaacccuccuugaguuggcccggacccaagggugagcugcaaccuccgccaggggcagccguugccagggguuauguuugagcagcuuggagaugagguccugggcgcccgaaggcacagaagaggggaacuucagguccaccugcgaguggagaaaggaaaggugucaccuguguuacucugaccacauucuucugacuacucaucccgucaggagcuagaggacacccccagagagguguuauuggcaguggacggcagcuaggggaaaagaggcauuguugggguuuuuuuuguuucuuuugagagcauggaacaggccucaguggggcuauaaaaagaaagaagcugugaaaguagguggggcacguguuggggaggaguccaggggagugggaagugucguuagggguggauaugaucaagguauauuauauacacguaccaaguugucagagaauaaauaaaaaguauuuacaaagcaggaacauuuuugcagagccguguacauccacuuugaguguccccagacccuggcuccuacaguacacaaaggcuaucgcaccuugacaauccgacgauacgucucacuguggcuagggcucucgaaggguggguuccccaccaucaguucauagcagagcaccccgaugcaccauagaucuaccauuucauuaugcaugcgccccucaaucaucucugggggcagauaguccagcgugccgcacauggucuuccuccuggugggaugagggaagagagucccagaagucagacggcuucucuuuucucuuuacuugacagugagcgucccagagaccccaggauguacucucgaguaagaggugguaaugauauaagccaaaagccagagguggacaugcacggcaccagcauggucacaaauaaugaauuaucuuaaucuuaauaaauaaucagagacaagggcaaugcuuacgucaaggaaaaaaacagaaaauaccaacacccaccaaacauaugcuacuuaaagaaaacagauuagauauuuuacuaugcaauacucugaagaauuaaacaaugaaggggucaccagauacucgcucacaucuacacaucuaaucccaacacuugguguuuggcuuuguuucuaugagacaggcucucucucucuccuagccuuugcuggccuggaacucacuggccuugacuucaucuguuacccugacuaccacugccucccuacagcuggauuuacaggugugugccacaacaccuggcuuaaucccaacacuugagcagcugacauaagauugucaguuugaggccaucuugggcugcaggguacucuugggaagagguuuugaagccuguagaugagucagagagcuagcauggagccuagcagagguaagacccucgguuccacccccaauacccuaaaaccaaaccaaaccaaaccaaauaaaaugugacauggguaagcaggcacuguaggguacgccuggaauagcagccauucacuuaaaccuggaccuuuaaggcaacauagggagaccauauuuccuucuaaaaagaacaggauuuugcaaggguaaacuuggcauggugauauacgccuguaauccuaguauuuuuggaggcagaggcaaggagaaucagaaauuaaaguuaucuuuggcuauguaaugaguuugaagucauccugugcuacguaagaccagauccugucucaaccaaccaaucaguucucagucuguagaaagggaguuuucucaacaauguggugagggaggguccacuauauuuaauuaaaaaaaaaaaaaagaaguaguagaacauuuagggcaugaauuccuuuuguuuguuuguuuuuuucgagacaggauuucucugccuggaacucacucuguagaccaggcuggccucgaucgaacucagaaauccaccugccucugccucccaagugcugggauuaaaggcgugugcccccaccacugcccggcuagggcaugaauucuugagucgccuauuucuguaaaguaaucacuaugucuauacugcaaggagaaaaaaacaaaacaaaacaaaacccaaauguuccugaggaacaagacacugaagacuuuuauaaagaacgucacagccucacaucaggaacagccccccaagucccuccauaccucagggauggggcaugcaccgaccagccaaagucugcaaucuucaguucucccugcagaccuaacagcagguucuccggcuuuaugucucugugaauuaccuucuucuuguggcaguaggucagggcaucugacaguuccuccaugaucugugaggguccacacaagaggcaauuaggcccucuguuuccagcaauggcccaggcacuagaucccacaccagguaggcccugaccguggcaguccgcugcucaucgaagguccgacucuucugcaguuccuuguagaguuccccgcgaggggcguauuccaggauuaaguagauccucugcuggucguagaaguaguuguagaguugaaggauguugggaugucugggggaugcaaggagaaaagaagcuucaggcugcaucuaggagcuggguggggcagguggucuaggcggaguaagacagagacagucgagugaggugaucccguuagcagagggaccagggucagggugacagcauacuucaggugcgccuggauuucgaucucucggcgaagcuggugcucuacccccuccuucucaaucugagacuugaagaggaucuugagugccacgaugaaacggcucuucuucucccgagccaaguacacguuuccaaauuugccuuugcccaaaggacgcccaaucucaaaguugucaauagugaaaggcugccugauuagaagagcgggaauauggggaagaguuagcuggcuggcucagagucuccagguggcugaucucucacuauccgugcuccccuuauccucccccauuucucccccaucacuguuuaaguuucccuacuuguucugggauccuugcgaggcaguggagcccugacucuuguucucagccaacuucuggccaggggcagcuaaggagagagaauuauguugaguccauccuuugacauucccagcuuccccccccaccucccucuucccaucauccaagguaccuguggacuggcuguugaaccgguucacgagagcaagcgcagaugucguggcgggcuccuuccguaggacucucugggacaacguguucaggccagacugagacugaggagcaaagggugacucugagggcguccuugucccgguaaccuggccagaauaugcuacaaggcgcauuucagcugcuugcuaaaggacccauccacucacaguucacagaacaauacugauacagcacggucugccugccuagccaagaaucuacucauugcuccacgugaaagggguuauuaagaaacaacuggcagccagcagcaguggcacacacuugggaggcagaggcagggagaccucugaguucuaggccagacugaguuccaggauggccagcgcuacucagugaaacugucuugagaaaaacaaaaguaacuugcaaaaauaaaaugaauaaaaagaaugaaacaacuugagagcguccagcacacauccacaaccccagcacuaaggagguggaggcuccugguuaggagaaaggcagccugcagccugagcuaaagaagaccuuguuuuguuuuguuuuuuguuuuuugagacaggguuucucuguggagcccuggcuguccuggaacucacucuguagaccaggcuggccuugaacucagagauccaccugccucugccucccaagugcugggauuaaauuagugcaccaccaccgccgccgcccagcuagaagaccuuguuuuaacaucacccuccacaaaaauaauuaaaaagcaaaguaaaugaacgaaugacaaaacaacccaaggcaagaggcuacuacaccaauuccccugaccccagcccaccgcaggcacaucacugcccagucuggauaguucuaaacacaucacccaggcuuauguaagagccugagcuugugaaguugaaacaaaacuucaucucuuucuaggaacagaacauagggauacugauggcuuuagggguguugcaggauauuugaccacacugugacccucggggaugacaaauuaggccaggagaauaaaagauauguuuacacuugggucacuucacuuucaaaguucucugaguaauagauauuuuccugugauaguaaaucaggguaaaaguaacaggacugcacgcuugucaguuugacucagggcuccacagaggaggaagcugggacaaggaaagagauagacuguccaggaugcucaggucccaccaacagggaacagacuauauacagugaagggcucuucaucuggggguggccacaggaucccaucauguagccaagugcguuacgggugugcuguauuacaggugugcaccaccgugcuuacuaucuccaguguggcgcacacgcacgcacauacacacagcauuucaaaucuacuuggauucuuacuucccaccgcucaguacgauacauuccaaagcuggaguguaguauggaugguacaucaaaacuuggaagcucugggguuucauacccagggccguacauaaauauuuagaucauucggaaccuuuuaaaccguaaccuucuauucuauaaucuauuuccuguguaguuaauuuuuucagacucgagagugagauucacgacccgaaagcacgaugauguuugcucagucccaacuauuauuguacgugacgagcaggcucagcucuacggaagcccucagauucagguuggcaacaucugcuacgguaagacugcaagugaucagacugaguuuugcaagcaaauucuugaggcccacacgucggaaacgcuuagaguccggccauuugcaaggccagccucuaucuucauggacucuucuuccgggggacguggggcggggaauguggccaggaccuuaccgucuuugagccguagggccacggguaggcguucuccuucugagccauucuccagggcgagagcgggaggggagcuggacagagagggaaacaacagcgaaggcaagagaugcagaggcagauccccggggagugcaagccugggcgggcagaaggaagcgagucagcacgcagccaaggucggggguacuccugcaccucuccuuccaggcggauagcgggcacguggauccgcccaacggaacccgaucagccccguggaccacugcagcccccgcaguuccccgcaaagccgcagccuacgccacuaggcgcucgcacacggagaaccgguuuaccccgcgacccggacgcuuucgaaucuccc

SEQ ID NO: 12477 - RNA, 2723 nt, Mus musculus
uuaggccacuuccuggggguggagaggaccucagugccugcugcgacaacccaggaaggcgguaacgcccgagcccugagacacuguucccaacagagucccgggacacucucagcucugacugcaagagcaucgccucucccaagccauacagaacugcuggcuaccggcuccuaucaguugcgccuccaucuuuugggacacacgccccuaacccuggcugggccucugaacagguccucggaacccgacguggacucuacaacuacaaaagcucagaaacucaaacugauccuuucagcguccgaccggugcucaccaccgucaccugcugguugaauuucggaaacccacugucugaagaguacaggagggaaucgcugaccacgcacaaucagaagcgucuggaccaaaagcucccugauccugucuggcugccgucuguuccuuucaucgguucuuucauccucucggggauuuuuguguccugaagcccccaaccaccaccaaaguagcuugggugagcuacaaacuuuacugucuuguucuccaaccucugccuccaacuuagcaagucugaacguuaccacccaauucuuuccaaacccccaaauaucugcuuuuuccuucuccuugccugucucuuauauuacccaaaauuucccccccuccuguguccucuuuacccccuuccuuugggggucccgugacccuaaauguggggggaacacuauauuccacuacacuggagacccugacucgcuucccagauuccaugcugggggccauguuuagggcugacacccuaaugccagccaaccuuaacccgcaaggagauggccauuacuucaucgacagggauggcaaggcuuuccggcacauccucaauuuuuugcggcuaggccgucuggaccugccccguggguacggagaaacugcccuucuuaaggcagaggcugacuucuaccagauccggccccuccuggaugcccugcgggaauuggaagccucucgggguacaccugcauccacagccgcccuacuccaugcagauguagaugucagcccccgccaggugcacuucuccgcucgaaggggcccccaccacuaugagcugagcucuguccagguggacaccuuccgagccaaccucuucugcacugacccugagugucuggcugccaugcgcaacagauuugguguggccauuggggacagggcagaaggagguccacauuuucggcuagagugggccucccgcccccaggaacucccugaaguagaguaucaaagacuggggcugcagccacuguggacuggggggccagaagaucgucgggagguagcgaacacgccuacauuccuggaggaggugcuacggguggcucuggaacauggcuuccgccuggacucugucuucccagacccugaagaccuucugaacucuagauccuugcgcuuugugcgccacugagggugcugcccuccacuugacugcagaggagggggaugagucagccaaggggccuguggcucuucuaaaaccucuuucuaguacuggugugguagcuaugaaagucagggauuccaccauaccuggccagagccuagagcugggguucccagaucgagcugcccccuuccaccccacaagacucacgaaugguccagaaggucuacgcgggggcuuauccugggaaagcaucguggauucucuagccuguuuuugcuugaggauggguccucuguauucagaaguguggcaaaguaagauagcaccucuuugcccaggcuaaaccuagcagagcucuggcggguugagcacuaggugggaggacuuugacuuaucaaauguaaccugcucccuagacugugguuuccuuuacuggagcugacaucuuauccuacaguaaccauuaagaggccaggacucucugggagguuucuuuacuauguuccaagccaccuauugugggacacuccauccuagggugacauagggagcaaggagaaccuccaucaacacgggggcuagagcucccuucuggaauuccagaggauccuguauggaaguggggcuggaccaugguguccagaggccucuuucaugugugugcgccugccagucaauagaucugaugcugccuggcucccugcugucuugguucccaucaguguugcugacuccugugcuuguguauugguccuucugugaucuuggccuguccaggccuguuugggguugcuuagaaacucuccaggcucagguacuucugugguauguguaaaagcagauucagauuuaguuuaaucauaggguguguguguauguguguguguguguguguguguguuugcauguguguuuaugccugcgcugccacguaggcaggagggccuuguuugaguuugagucacacuaggcccuuccuaugagagguaaaagccucugggcuuagcugggccucugagaccucugggagcucuugguugcugagacaaccaugagccuguugcuaggaaauagcuggguaaggaaggccuaaggcuguccugggcagccaggagcuagaguugggagagucggggagggugugggaaggauagcauuucuggguuccugggcggaugggauacacacauaaacauggucaucauuggguggagucauucaucuaucacugugacuuacaagaagaaaaauaaauugcuuucagaaccau

SEQ ID NO: 12478 - RNA, 8023 nt, Mus musculus
cggggaccuggcagcaggcgaggaggcugcgagcgagccgcgaacccggcgggcggagggcggcgagcgcgcgcgcaccaugggagaaaaacccgggaccagguaagggagguggggccgugccgcggggcaugggcggcugcucguggggugugccagguugauccacagacaaggacaccggggaagaaaccccggggccggacgccugggucccuagaggguagcgguccggggccgcaagccuugguccuugagauauuggaguggagcgugcgugcuagggcuccugcaaaaagcaagaccugauggggaucgggaaacccacgccuggguucucgcagagauguaggagucggacuacuggguucucugugcaggcugugaugcaagggcggaggaaggaggagcagguggccggccccgagggguugugugcugggagacuggaugcugggaagggauuccccuagacucgugcccaaccaauggaaagccuccugcccaauaccccacagucugauugcucccaccugucccaagggcccgauagcucugcuaccaaacuucugccuucuagguugcuaggagcaacagcuucuucuugagagagaagaguguguagggacccucgcugaaauuggacuguauuccucuccuggggguggaggggagagguaguaucuccccuggacacacauccucuccccggauguucucugugcaaucgaagcuccuuccuuccacugauaccagaguucucuuuuuuggucuauagcaaaauccacuuccuguugugacccaacacccccaagaggacauggggugaaugcuugaguuccaaaggagcaagagcuaaagaauagguaggggcuaugugccucaagccggagaggaccaagaauaagggccugauuaugagcagugacuucugcaaaacaugggaucaaccccaccacucccacugcccuuagaguaugagaaaguaggcaucucagcauuaagaagaccaauaucugagagagauguccacagggaagacugaccuccuggauuugagguuaaacaccccagagaaaggggaagucacuuacuuggggggaggcccccaaauuuccguuguguacuucagggaggggguagaugguccagagaaagacugcugacuuggcauaauucccuaccaucucaucaaauucugggccacaggaaauggagagaauggcaggaagugcuaagaggcaucugcuuuagcugcacccccccccccaagcuggguaccucccuggucauucccuuacucugccuccuuggccagccucaguaugugcccacugcccgcucccuaaccaggcaagagguggcuggggaagauguagagagcagaugcucuguaguuaccccagggcaauugccugagacacacugguuauggcugucacaggcucugucagggcucccauugggggaaaauacagggcaggaagaaaccagagguagaagagcuagccagccuaggugaugucugagcugucagcccuaauugggacagaaauuagagugauuguucuaacugccaccaugucccaaugugccuuauuacuuggggauacguaggggcgcccuauguauaugccauaugacccuaaguaugacccugugauguauggacagcuuggcuuuuggggaggaagagacaagugguuuucugagcagacauuuacauggugcuugaagggaggauggaacacggggcauuauucaguguguuaccugggguccuuucccaggaauugccccuggggcagcaugccucacagggggcagaaugacacuuggaagaauaagccaccgaguagccagagcccuggggucacuagacaguuuccuacuaaugcucccagcagcggguggagucuaggcuuagguuguugcaguacccguguaaaaaaauccccuuugacuugacaaacugugacaggcaagcgccgccacuauguagugguugagaacagggucuugaagccaagguaccuuccuuaaguuuauauccgagucccacccuguacauucucugugaccuuugacagaauucuuguucgauguaaaacagggauguuucagucucagccauugggcuauaagagcaauagaugcaguuggaacagagcagccccccuguaccauguuagccgcaucaccaucuuugccauaggaugcugcuguguugggaccacaguggauuuuuuuuuaagcugcgaggcuguuggagguucacgaaauagucagacuugggcaaaaaccaucugaggggcagagacuaggcucugcuccgggagucacuguaugggucccugaagcuagaggucaguugaaaagauuaucugagugugaugguuugugccuuucauccucgcaccaaggaggcagggacaaauggaucugaguuggggccagccuggucuauaugucaagauccacgcuagccagaguuacauacgaaggccaaggucaaaaaagggggguggggagggguguuaggugugacccagacaguguguauccauccaguucgcucucaguuuuggagaggguccccuggggaggagagccuggguaguuccugggguagcuaguggccauuauuguaagaggaggagugaguuauguagcaucgaacagcaaaggagcaaaggcucgcucgcccugacaguuggcuucgaggggcugccaugugggaaauacugggacuuuauaaaaaagcagugggaaggguagggcagggauccaggcugaauucccuucucaggcuggggagggauaaguccugguguggugguccuugcccagccuaagggaggcaguggggucuuccuuucuguuuuguuagggucuucaagaagucgagcccuaacugcaaggugagucccccucgaugcuuacccuuugauccucccugggcccgaucaaagcccucgaugauccccaagccuuugcuccccacuuccugugacagcuaaaagcagacugacuuccuucccuccuuaagccccuugccgcagucugaagaagccacagggcuggguggggucuggguuccuaagcaagcuuguaacucucuuagaaaccaacccagggugccugagcuaggaauaguuaauaguuucccaggcugugggcuguuuaucucagagcccuuuguggggacagcugcuaccugccuggucuggcugaguguucccugaagacauagaaacacacauaaacacacacuuauguguaccgacccuccgugggugggcagagguguggaaagcagguaaaagcuuaaacgaaaguuuuacuaaguugucuggaaaacucuaccaaucucaccuuccagucauacugggagacaauccuuccugauaacccacccaaggggagcccagaacaggacacccaccuuugagaacucugguggcuugccaccauccuccccaauuuccccugugacccuugaccuccucagcucaccguguacuugggcaagcgcgacuuuguagaucaccuggacaaaguggacccuguggguaaguuugccuagauggcaccaacacaucaccccugcaagaggggaggugauuccugggucugggaguggcccccuucagaaaaugaauccaucucucuuuccuagauggcguggugcuuguggauccugacuacuugaaggaccggaaagguacuacauguaugcuggaggggagaagacaacauuagaugggcugacauugauaagagaggaaaggaaggcagcaucagaggcagggaauaggauuccgggaagucuguuaugccgaagaaggaugugggugccgugaagaaaggggcuucuccuaaucacccugacucacccuuacuugucaguguucgugacccucaccugugccuuccgcuauggccgagaagaccuggauguacugggccugucuuuccgcaaagaucuguucaucgccaccuaccaggccuucccccccaugcccaacccaccucggccccccacccgccuacaggaccgacugcugaagaaguugggccaacacgcccaccccuucuuuuucacggugaggaugcucuccauuucccgcagggcuuggggucuggggcucuuugggauugacaugggaugaggcaccuguuaccaguugaaacgccuccuuuuuccucugccacagauaccccaaaauuugccuugcuccgucacacugcagccaggaccagaggacacagggaagguacgggagggacgacucucacaauaugugaauagaaccaggcucagcuagauacacaaagcacagcugagcuggagggugaaguguagggggcuccugaggacagggugguauccccagggagguguguggucacugaaucuguucucugaccugcauguaccuggcuggguauggggucuccucugugcacugccaugagccagccucugccagaugccaggcuagagagagagacaguggggcaagagaguuccucuguuuccaugaugaggcaaaaaauccacaccaacaggaaugaagcaaggaggaaggaggggguguguuggaugugguaccgggagccuuggguaagagguggccuuuccuccucuucccaaggcuuguggaguagacuuugagauucgagcuuucugugccaaaucaauagaagaaaaaagucacaagagguaagagaaacagcucucucacucacucucucucucuuucugucucucucucucucucucucucucucucucucugguuuaacggcucccacccagccucacagcgccccagaccccagugggagguaggaaucugaauuggcuugugguaucuugaaucuaagucuuuccccuccuccaaccccugacucaggaacucugugcggcuuaucaucagaaagguacaguuugcuccugagacacccgguccccagcccucagcugaaaccacacgccacuuccucaugucugaccggaggucccuccaccuagaggcuucccuggacaaagaggugaggugugagagggugacaaagaugucacaaagcaggccagacuccugggaggaggggugaagccacaggcaagauggugauuugggaggcuuuuuguuguuuuuuuuuuucuuaaggcuauugccuuacuuggguagagguacuguggguaggaguuggggguggagcaggccaguggggucaguaaaaaaaaaaacagguacaagcgaugcaaucucuucucuucaaaagcuguacuaccacggggagccccuuaaugucaacguccaugucaccaacaauucugccaagaccgucaagaagaucagagugucugguaggaggugggggugggcauggggauagggaaggaagucccuacuuagaaaggcugcugcugccaugucagcccaggccgugucgcagugugggaaaccuaccgggccauaaagaauugagucuguuccagaagagauacauggcccuaguguuuacuauaguaggucuguuggccagggguggaagguggaggugugcugcccccaugggguuuccaccauguggucggggguuguggugccgaauugucugugucacccaaagccacuugguccccugcccccacagugagacaguacgccgacauuugccucuucagcaccgcgcaguacaagugucccguggcucagcuagaacaagagugaguaaggguuagaggugggacccaagcgccggucuucagaacccaucucacuucuaagggugucucuauagccagggggcuccaagcuguuaacucucucgaacagguugaaccagaaccuacccccuccuaaucugugcccaaauggacagugagggaggagagacugccugagggugguaagaugagccuccccuagcccaggcucuccaacaaucuuguucccaaccccccaccccaccccaccccccagugaccaggugucuccuaguuccacguucugcaagguguacaccaucaccccgcugcucagugacaaccgagagaagcguggccuugccuuggaugggcagcucaaacaugaagacaccaaccuggcuuccagcaccaugugagaggggagaggggggugggggacaggggacaggggacaggcuuccgcugagagcaggccucgugccaggcucugugcugggugccaggaagguaucagugaacagaaaugacaaaaacuucucacauucuaagggagggaagacagacaauuagauaagugguaaacuagauaggguguuaggaacaaguguuaaacagagcuguauaaaguagagagagauagaguacggcagagaaaguagaggaagggguggggugugcugauuuuaagugaaggacccagaggaaggaggcauuguggauggcuccaggcagagagaccugcaaacugaaggacaggugggaugguccccagugugcaugagaaauugugaugugucacuguggccuugggcauguguagcccuggaaaggccagagcuucacccaguuguugccucugcacuggguacacacgacaccaccucccaggcccacacggcgagaagagacacaaagagaacuagguaaagggggcugcacgugcugugcugcagaccaaagcaccccugugaguggcagagaugaggccccaggagauucugcauccaggaugccaugagccuguauggccaugucugcauagcuggugccgcaggagcccuggaucccugaccucagcuucccuccucccaaaugcagugugaaggagggagccaacaaggaggugcuggggauccugguauccuacagggucaaggugaagcugguggugucucgaggcgggugaguacagcguggggguggggggaugugcagggccaccggguucucuguggauccauggguugugguaguuguccucuucacacagcuccucucccucccgcagagaugucuccguggagcuacccuucguccuaaugcaccccaagccccaugaccacaucacccuucccagaccccagucaggugagugccacccacacgcugagccccgcagagaggagcugagccagggucaguggagaagugaugguccuuucagcgcccauccacccaccccuucucugcccuucagccccccgggaaacagacgugccuguggauaccaaccucaucgaauucgauaccaaguaagaaacacccccugccuucuucauugauccucuaggauagagauucccaugccauucagauccaccccccuaccuugugggucguuuccuccugcuuauagaggcuguggcuacugcccugggucuccugugaaccccucugggucuuuuaccgcuuaagugcuugacucuaggauggggugggaggaaggcagagugggaggcccaaggaagggucagaagcuuuuauuacaucuccuccucacucucaccaagcuaugccacagacgaugacaucguguuugaggacuuugcccggcuccggcugaagggaaugaaggaugaugacugugaugaccaguuuugcuaggacgaggggcugggagagguaggggcgggcaggacucaggucccacggcccucgagggugggagggucccagccucuccuccuuccccgucuguccgucuguccacccgagauacacacuggacccaucacuuguugaaagugggcauuaaucuucugacuucagcucgcugccccagccccgcucccuagggcggcaagcuguguacacaccuaaaguuuugggaagggaacagugaacgcaaggagugaauguagagaaaagguguagaaagaacgcccauguuuggccucacaccaacucgcccccagucaccacuucugccucccaauccuugaagacgagacuuuggggaggggugagcaaggccauuucuuuguuucugagcauagggaagaaauaaaccuuuuaauaggc

SEQ ID NO: 12479 - RNA, 12106 nt, Mus musculus
aaggaugcagagauaaguuuauuuuggagccaaaugagugacugugguccagaaauacagauucaguuugcuucagauaucugugcucugaccuugguaacaauuucugugaaguuuuaaaauaacaaaacaaagaaagucacuuuacaaauucuggugguacaacaggugagcgguuauagcaaagcgggagaccuugcuauaggcuccagaugcauaugugaugacuuucuuagcaguugggauccacucauauguuucaaaacuuuaccuaggagucacaggauguuaggucacacacagaugugggcaaauggcuucuuuuuaaggggcuaagauaguucaagauggcccugcaccaugugaaccucccuaugacgauugcccuucuaacaauuagucuuuuaagaacucccaguauaaagacuuucugggaacucuaauucucccuggucugccccgcccugccccuccccuuccuucccuaccucccccucccauucuuucccuucccuccccucccucccccucuccuucucuuucccuuucuuuccacuuuccccucccucccucuuuccuuccuuucuccugcuucaucucccccucuaggccucauauuccuaaccugucuuguccagaagagccaaugaggaaggcaaagaaaaaggucagggagaaacuuaggauaaagcagggguuucuugagccaccaacccagcaguugagccuaggugcucgaguucagugcaagaagcgaaagccuuuucuccaggucaucuguagcucagaagaaggaaaagacaucuucugaagaccaaagaugaaagccugucucuuuucuuggucacccaaagugccaagagcacuuugagacaguugagugacccugaccugagcccaagaugacacaucccucccaaggcccaggggacauuguggaagaugaggcccaaagccggcaagagccaaaguauuaggggcugggugggguacuaucagaugcucuuuucuggauuccgcauggccauggcuguugcaaacgggcacacaucagcugugguuacuguuggcauaagaccuggauaagcaugugcauguuagcaugugugugugcgcgugcacacacagcacccgcaaacauggacucaagaugugaaagcagagaacuauugggaagaaaagagguucauaggaguagguuggggcaacggaaggcaauggggauaagcaugauuacaauacauuguaaacucauaugaaacaguuagaaauuaaaggguggggggaauucaguuacagagacugguaaagaaaacaaaguugugaccacuaggaaaggaagcuggaaagcuagugggaacugggaagcuagugggaucugggaagcuagugggaucugggaagcuagugggaacugggaagcuagugggaucugggaaguuagugggaacuggugcucuucaaucuucggaauccagcuggccauccucacuggaguuucuuuuuuuuuuuuuaaaaugaagauaucuuguccaugagaugcuguuuuuuuuuuuuuuaaagauuuauuuauuuauuauauguaaguacacuguagcugucuucugacaguccagaagagggagccagaucucauuacagaugguugugagccaccaugugguugcugggauuugaacuccggaccuucggaagagcagucgggugcucuuacccgcugagccaucucaccagccccacuggaguuucuuuuggugagcuaaccucuggcacuucuccuaaagaaaugaaaauagauguuagaaagcgucaacaucuaaguuauuaagcuauuuucuagcuuuccugucauuggucuuccccaccaacaggggcugucaaaggcagggcuuuuuagaaugcuacaccagcacuuuguuacacggugcugcuaguuucugaaccacccccucuggguguugcugucccuuguucugaaccaaggggugguggugcucugauugagaccguauagaaaagacucugagcagggagggugacuaaagacuugggguagugccuuauggaggugggcaucacaggggaauggggagaaacgcauguacauccucuguguagccacuggaauuagggagccguguuguuuacuugguuagugccaagucacagaacugaggggcggaggaaugcguauaucaacacucccaaagguucguguuuguauauggguguaucagggcucacggguaaaauacagaugacucacugacuuucuguuucagagaccugaagaaucaccaugugagaaauaaugaucccccccacccccucauaauaagaauugggagacucagaguagcgaaacagaagcaagcaguugaagugacuuacaaccuuguacagucucuacagaaagggcaaaaaugguuagcgcucccauuugguacaagugguuuuuauaguucucaagugugaaaaacuucugcccaccauaggcuccccaaguggugguggugguggguggugguuugagagccuucucuauccuagugcaggggcucaguugugcaauguuuucaacccugacauaaacuaagaagcauccgggcagaggcagacaagggcaguguccccugcuuacuugggacucaguagguacuucuagauguacuuucacacugaaacacauuuucauacugaaaauggaccauaauggcagaucucuuacaaugucugcagacauacugagauuaaaaaaugguccccauuucuuugaaauucaaguuugguuggggcauauuguacuucuccuugcuaagucugacaaagauggagaaaagugcggaagcacccgacucagggugaaauuaggucauucuuauaaaacauaaaugcauaaagaaauuaaaaaaaaacuauugagaucuccuguuuuugaaggacugcaccucugggggugggggaggcaaacagcagaguaaugaauauucuaagauaacaugugggccguagacuauucagcccuguguuugcugauaggguucccguugagaacccacaggcugcugaaauugcuuccucagggaugugacuggagaagaguaagaggggagaaucagcuugugugcgugugugaugcugaagacugaaccuaaggccaucugcaugcaugaaggacaaaugcuuuaccaccuaaccauuuaccuagucuucccuucuccauugauuuguuuguuuguuuguuucuuuguuuacuuaauuuuugacacagggucuuacuuuaacuuaguuggccuugaauucacuauguagccuagacuguccucaaauucagaguccuguuucagucuuccuuuuuaaaaauuuguguggugggcaaauaugugguugaagguccaugcucccauauguaaaggccagagagugccaucuugguaugugacucuucuugucuuuucuugaugugucucugccuuguuuugggauagggucucuugcugaucuuaaacacaacauuuugucuagacaggcuggccagcaaagucccugggacccaccugucucuguccccugagcacccugagguuuccggagugagucacugugccuggcuuuugcaugguaucugcagauuugaacuuauauccucgggcuugcacagcaagcucuuuaaccacuuaguuaacccuuuagcccccgccgcccuuaccuuuccugagugcuaggauuacagggauucaccccucuaccugacagaguguguugcuuagguuuuuguuaacucaacacaagcuauggucaucugggaagagggaccucagaugagaaaaaugucacauuggccuguagcaaauccguguggcauuuucuugacugauaauugcuguaaggagguuuguugugggcgguaccucuggugggcugguggucaugggcacuauaagaaaccaggcugagcaagccaugaggaggaagcaagccaguaagcagcauuccuucaugaccucugcaucaauuucugccgccggguucuguacugacuuccccaagcacuaaggugaaauuaacccuuuccucuucaaaugccuuuuaaccuccccuaccccucccaaaaagccccaaaacaaucauuuggaacaaucauuuggcagagcagagguagugaacucuuuaaucccaguaccagggaagcagaggcagguggagcucucuacauucaaugccgguuuggucuauaaaacagaguuccaggacagccagggauacacagagaaacucuguuuuggaaaaaaugaaaacaaaaaccccaagccaaaccaaacaauaaaaccaaaccaaaccaaacaaaaccuaagcaacuaaucaaacaaaaacaaacaaaaccccauagcaaaagaagauagccuuggguggaaaacucaggaugagaaaggccagcuuuggguaugcuagaggcaagccaccagccgccuucacaucuggagucagggccuucugccuuaucuccaccuggagggaguucacugacagcccugggcuuccaucauucauguggcccuggaguauugccaaguguagggucugauacagaugcagacacaggagauagauugaccuuccuucaaagguuacucagugacugagaggugacacaaaccagauagccgagagaaugcacaaugacacagaagcagaaggaggcacaggaggagccacacauugggaagcaaggcuggggugcuuuaagacacugcagcagguuccuagacaggagaggaggcaguuagggaugcaaggagaacaaaguaccuggugcucauuuagaaugggcaagggaaguaaaauucggcacugacaacaguucuggagagugucauaggccgucucgucuccugugggaagaucagcccucugcuggagcccagacuucaaaggcagagccacagugccauuuuguuuuuuugucucucgcuuuguugagcuguuucuauuuuuugucuuuggacgaacaucuuuacucacuguggaucuucgauuuccagaguccauaaaugcaaggguugaaggaaugacuauuauacuuucaucccgaauacgugucacaguguuuggggcggaacauuguuucugcaaaugucaauaaugugugaaauuaaacaagcaauuacuuaagcuauaauauguaauaguuggacaagacagccgagauaaccugaaaggcuucccccuggauaaaggcuagcaagauggcucuguggguaagggugcuucuugucaagccugaagauaugaauuugaacccuggaacucaaacaguagaaaauccccauaagaccuuuacucagcaaacacacacacacacacacacacacacacacacacacacacacaaacacacagaguaaaaauauuuuuaaaaugcuggauaauauaaggcagacauuugauuuuacagcuaacuucgcuagaagacucauguuccaggauggaagauuggguacaucccucuaaaauccagguuuugggggccggagagauggcucagucuuaaaggggcuugcugcucuuucagaggacccaaguuugguugguuuucagcacucaugccagacagcucacaacaaccuguaaguccaguucuagaagauaugauaccuucuucuagccuccauagacacugcacgcauguguugcacauacagacaaguaggcacauauaaaaauaaauaaaaaaaauugaaaauaaggugugagucuuuaauccaagcacuugggaggcagaggcaaguggauaucugggaauucaaggccagcauggucuacauaucgaguuccaggacagccagggcuauauagagaaaucuugucucucuuuguccccuaaaaauaaaaauaaaauccauuauguuacacaggcuaauagggggcuguguuggucaugacugcuccucuccuugcacacucaugggauuguaaaaggcuucaagcagccuggguaacugcugcuggcuugcucucuugcacucugcuguucaugcagccgcaaggcccucccuaggcuccuaacgcccacgcucugcacuuggguucuuuggcuucagaacagugagaaauacauuucuguuauguagaaauugcacagccugggguuuucucucaccgagcugcaaauggauggggagacacgagucuuguaacuaggggcucaggcaaggggaaaauccuaguuaguaaaagaugagaaggaaggaaaaaccccuuccccugcaccacacugccaggaauagcaaguuucaggugcggcaguaaauaucaaagagcuaggucaccucuaagccccuuaguuccgcuguuccaacgugguuggucuuucuuucuuguuuguuuguuugcuugcuugcuugcauuuucuuaguucccuuuuccuuuucccuuuccuuuucgacagugucuggccucaaauugagggaucugccugccucugccuccucagugcugagauaagucuauagcccugggcagggcaggugggugggugggugagggggugggggacaagaagacguuucugggagagaagcugugggauguuucucaagaggagaacguuccauaagagaagagagcagcuuggcucaccagugugcuaaaaggcaguaaggcuauggagucaaccagcuacaucaucugcccuuuuauccucaguauccugugagcguuauuauagaaagauggggaaagcccuuuuagucucaugggggaggucauagccuaaacaugggcagaaagcccaagagguuauaaugcccaggccuugaagguuggugauggucagaggugaucagaggcauggggaguugucagagcugcucuuugaugggauaggcaaaaugaaagccaacucuacaaaucugcccaaaggaaaccuuggaacaaaccaaaccaaauaaaugaaauaacaaacaucagaaccuuugauaacugugauuugcgaaguguaucgagaaucugcugucggaccugcucuuuggaauacgaacuggcuccuggcacaguuagagagugggucauugccacucaccauaugggaggcauacguauuuucuggaaucauuuguuugcaaagaucacaacggguuuuucuuccaggagaugauacaauucucuucccugaguaaacaaagaaacacaaaugacuguucuugagaauagcuaguccaucuuuccccugguuucucccucggccuguacucaugagcauucccaggcuagcccggucuuaggcuugcuauacugcuagcugccuuagccacacaggaaaggcuuacuggacgacuguuuguuuguauuacacugguacucagggcagaagaugacccagaugaagagacaucuuccuggagcacaacuguuuuuuaaucaguugaaaggggcuguacagaguugcccagccugucgaauugagcuauucuacccuguucccagcucugugauucaaccagguguuguaacaucgugguguuaaaguuguguuguauugaagcugucaaugaacuuguguugcacacuguugguugugugggagcccaggcacaauguaaugaaggaaaagcacacaaauuuccugccuuuccuccagccaauuuugaccuuggguagaguguugaccuagugggacuuacgaagcaguuucacaguuucucugcauguuaucacauuaucaaaacaaccaaugaaguccacgaaagaugugccacagagacgucugugcucuuggcaaacucuccuauaaagaggucauugaauugggucaacagacugcaaagaggucagugcuagagcacguaugaggcucuagguucaaaucccugguacugaacuggagauagagauggggguggggggaggaaggggagugaggggaaagaaguaagggaagggggagaaagggagggaguaagggagagggagauggagaaagggaaaagggggaggaggaagagagagagggagagggaggagagagagaaggagaaggaggugguauuagaaagcugauauacaaaccuagucuugaagcagcagccucccaucuggccaucacuaauugcugugguuugaaugaaaacacucugcccugcuugugagcucauguguuugaacacuuggaccuuagcuacuaaaaugcuguuuugggaaguuguggcacccuucugagauagagccucccuggaagaagucagacacuagguucagguuucuuagcccaaccccacaucuugugcucucugcuuccugacuguggguucagggagacagugaggaguaccucaugcugugaucaugucuuccccaacacaucaaggcuguuauggccucacacugugagccacaguaaacccuuccauccucaagcugcuucugccucucucucucucucucucucucucucucaaauuacagaaugauaaaaacauucaauagccuaggauccagcucggugauggaaacugggguguccacuuuuguuuccugaucucucuguauguuuucaucuagaggugcaccuuaccaggcuagcgccauguccuuggaacgaaaagaaagcccuacauguuuaggauucccuauggcuuucucccucuucagugugaguucuuauaacccccccccccccgccucuuguuuucccugauuaagucacugaagacugcugcagacacacaagaaggcuacuccaguuuaguggaaacacacagaauagacacaccuccccugugcagucaaggguucuacuucuugcauccugcccaggagacugucuagcccuggaagcugcccucucccucuccagcuucucucugcugcucaccuuccucaggccugcccuuugcacucagacacauggcuuugugcugagacaguacuuggagugugaugggcugguugcaguguggacaaugcucuguccggcugccacagugggacucauggacauccagauugcuaagcugcacggccagcucacagaacuugcacuuggcagggugcuguuggcuuuccuuggucugugggaagauggaggacauagacccaaccucuaagggaacugaagucaaucaaagaaaauauuggcaagggucagaggcacagaguguccuuggggauuaugaacuccuuagacucauuauucuaguuuauuuucuguugcugugauaaacaucaugaccaaaagcaacuuggggagaaaaggguuuauuucauuuuauacuucaacaccacagucuaccauugagggccaggacaggaacucaaggaaggaaccuggagguaggaauugaagcagagaccaugggggaguugcugcuuacuggcuuguuuggcuuguuuucuuuacaauccaggaccaccuggcacaguggacugggauuucucaauucaguuauuuaucaggcaauugccuggagaugcacccacaggacaaucugauggaauucuucaaccgagauucccucuucccagguguccacagcccaugucaaauuagcagaaauuaacucauggaugguggaaaucuccucugucaagcauguacauauguauguaaguauguuugcauguauguauguuuguauguauacaugcauauaugcaagaauauauucagaugcagaugaaucugcaucuuucggguaggauaguccuucaucauucuccuggccucucagguggggagauaauggugguggugggaauuuuuaugacuagccucucugucuuucaaccagguuauccuauuugccuauagagaagaauucacuccuacuccagaaagggagggcuugcacaagcugcugacauaguccaaacuacucaaacuguucuggcuaguuuuauaucaacuugacugaaguguuuguugggucagcuugaaucuaaauggaugccugaacuugauucucagaaagauaaagccgcaagagacugacucaaaaagguaggaaagaagacugagaugggcccuccugccuccuccuuacaagucucugaagaacaguuagccuuucuuuauauggauccuuuguucugccagacccauagucuugggguagcaagaagaaagggagaaacuagggacagccucaggguaacacaaacaaaaaacagaggccaaacauggaggggcuaaauaacuuacccaccaggccagggaaggcuggacuccaguuguugaccccccaggccucugccccaccugcccaccugcucaccugcuggugcacaacuuccaugugcucuuucaucuuugacucugggaugggcucuucacauucugggcaaaggacuaugaagcgcaggcagugggccucguggagcaugaaguggagagaggccacauuucuuuugcuucaggauaaagugggggugggggagaaagaaaggcacagugucuuagcauaagacaugacgccuuguugcauaccugggguaagcucuuuccaggccugcggccuggggaaaacagugaugaugcugaugaugcauuccuaugccugccagugcuggugaaacagauaagcucgccaucagaaaauaggugugagggcacugugccugggagagggggaggaagaggguaccagggcaacaggcaacuuucaagauugaugauagauuucauuuccuagauuguaagaugguuucacaaauaaguacuguguaucaagauguauauuucaaacauguacaaguuagcuagggcuguuggcacagggguucaggagccugagucaggaagauggcuaguuuaaggcuuaucugugcuuauagaguaaguucaagaucagccuaggcaacuuagugauacucugugucaaaaggaaagggaaaaacagagccagggauaacgcagcucagagugcuuggcugcucugugcaaugcccuaggcucagugccuggaacgacuccucagcaucaccccacagagacaggguugggggagguaaaguucuauccuuuuccaguuaucuccuagaaaggccaucacgagaacaagggagcacagcagugcagcucugcccugaccacaccucagacccuccaaggguuucccaacucucaagagcaaaaguccauccaccacgcugucucccgucccugggcucccuugcagcuacccagagagcaucugagaugcaggggagucuuguagggcaggguguccuccucugauaggcucaucaccaggaacgcugccaacccauuccaucugcucaugcucacggcagcucgggagaaaggaaacaggcuguauccuuaaaggaccaauuguucaggcccugugaucuggcucauggccuccaauuguucaggccccugugaucugguucauggccucacugcuguuagccugauccagcuguccccacaaccgcacagaaugacguccuuugcucuguuugcccucucuguuuugccugccuccauacuccauagaccagagauccugaaaggugaaguggaacaaagaucucuguggagcuuuaccccaguuacugcaacagguggggucugcugaggaaccagcucuuuuuacuuggaggugugguccuugccuccugcucagcccuccauguucuaucucccagcuccuuugucaggcggaggacaggaauaacccuggaacaucucucaaaggguccucucacagaugggugggaagaccacgaugccccccaccccugcuacggaucuaagcucugacaggaauagccugcuagggaccagucccuccauacuucauggcuaaaacuagccagccugaaauacccaagcuaagagggaacagugauauugagguaccacugagcacucuacuuagagauuuggaaccucuucacuccagagguuccaguccccuucggcuugcccucugguguuguacuucauccccaucacuucagaauuuguuugcucugcccugccccucugucuggccagcccuggagaaaaugccuucuuaccaguuccugcacacuuggaagucagccuccauggucaagcuuccugcagugcuucuguggaguuucguuucuuugcacacag

SEQ ID NO: 12480 - RNA, 2867 nt, Mus musculus
ucacaugaaccuuugccuuuauuuauagggcuaccaaguacaggucauccugucccccagcuuggagcugacacagggggcugccuaugacugccaguggucugaguacuaacuugcaaacccaccaauuaguuacagaaaagcaaauagaccaaaggguuuauaaaauuccacguguucaaucuccuuuugucaaggaagcaaucacuguaaggcaagaacaaggcacagagaccaaucccccacccaagcuguuaaaaagggaucucaaaucaguacaugggacuuugggguauaauuccagucuauccuuucgugaaauuuuaaaauguuuaguguguaugagauggcauguguuagcuagcagucagugccuuuaaccugcugagccaucucacugucuuuugguggaaaucuugagcccuaaagaagccagaggccuuuguaacugagucagacuucuauguaaguggaguucggggcaagagaauacauggcaaggcucugccuuggucaucuaacagagguuacagagagcguuccuguguagcccucucuguccuggaacuccaucuguagacuaggauaagcucagucucagaucugccugucucugccagugcugggaugaaaggcacgugccaccacuaacugguuguuuuuagacuagacuguccucuaccucugccugcauguaccaccauggccauugggucauugacuuuuuaaacacauaucauguacaacccugggaccugggacuagagccucuggaacuaagagcuauagauguuugugagcuacauuguggaugcuggagcccgaaccuggguccuuugaaaaagcagcccauguccuuaaccacagaaccauuucucugauguauaccuugaaacacuugugugucaagaacauauaacucuggguauaagaaugacuugggaguaacuggccaacuccaacuccugcucagugacuaagcucccuagaagauauuguggugugggacuagguaaguaccuugugauaucuuggaaaaacugucuuucagaggcagaagucagaaagcagcgugccuauguguguggcaagauugggcacuggaagugagaagaaaaauggcaagaaguuaagcugagcaggcuacuuaagcuuuggcuuucucaacauaucaauaauuagcaucaucaauuaugaauagcaguaaucucagaaacccugaagauggcuucauuaggaaaaggcagguuacucugugcugucuuuggccucuacccaacauaugguacuacccaagucuucaagcucagaguucagagggggauggaacaguuauggaagagaaagcaauggccaagccagggaccaggauguaggaaaccuaaaagcagauggagccaagcagagccuugccaaguguuuucuuuccccaaacuccucaaacguaaaacuuucugauucuaagugaccaagauaucuagcuucuucagucugggacuuaaacuuccacaaaaggauggugacauggcucagcagguagaggcaugacuugccaagucaaaugaucagagcucagaaagaacccacaugguugaaucaacuccccgcacuuauccucugaucuccacaagucugcacccauacacacaauaagccgaauuuaaagauacaaaacaauaaaugacuuccaccaaaaauguguccuuggguuugguuuggugcugccccaggaucggggcagcaggagaaaggcauucaacaucuaaagcaucgcuuuauugucugucagucacaggggugccagccccugccugcccaccccugucuucucacaggcucucugggcuuauguguguccugagaacugacaguugucuuaacuagccauggugaggagacaggggagagcugcuggacaaagugggagcagugcggagacauuuguccauccuucauucugcaaacugguccaagaacuuaagguaggccugacgcugagaugcagcugcuggaaugaagugaccaccggagugggugagggugacggcuccaaggaaucggcuagccaauugcauacucuccugagaagggaugacucgaucaguauccccaaaaacaugaagugaaggcagugacauggggcucugcaagauagguuccuuaaggccucggggacagaaccccgacacaaguauaauaaaucuuggcaaggggaagcgaggaucgccugccuggcccagggcacacacauaagcugcuagugcagcccccuggcugaagccaagaaguccaucaaacggccccagcgugucaagggcccgugccaccguuuccagggccuccugcagaccccugcacacuguggacucuuccagagcagagaaaacaucggcuuccuccucagaaaaccaccagccucgaggcugcuccuccggagaacagggcccuagaagcagaugggagaagagcacaggcccaggguuagagauggugagaagaaaaaggcagagcuugggaaagugcagccaggggacuuggggggcgggagggaccuggaauggccuggacacagauaaaggaggaaaccugggagcucagacuagagccggaguuaaaggcgcuaggugagaacugagguccaggugugcgaagggguccagcaagucucacccgagucuggacacgaacccucgggagccgcugccucggggaccgggugagguccgcugaggcacacaagcucugcccgaccccgcagcgucuuccucagcgcuccggucuucucacggaagccccgcucgcucugccggaagccggcuagacacagcacucgcagggucugccgugccgccauacugcagaccgac

SEQ ID NO: 12481 - RNA, 57274 nt, Mus musculus
cgcggcaggcagagcacgugacucuuccgaggccggguucgaggccuaguggcgggauggcgggacgugagggcggggcgcugggucgcagugcgccugugucagcgcggugcuacugaguuguucccccgccagcugucggaacuuugcccgcccaguccuuuggcggacagacagaauggcaacccagggaacagucggagcucuccccugguaacugcugcuaaauauagucaaagcagugaccuggguacuucuucacgcagugcgugcccggcgccggugccaggcccagagcuuggcacugugggauaaacaagguaaaucagacucagucuccgcccucuugaguuccaccugagaguuguggccgcaaggaacccagccucaaggaugguagacgcgauaugggccacacauguggagcuccagagugggggucaaaaaucaaucaggcuuucgagaggcgaugcgguuugaacugaguuaaaguguguguagaaauuugucagguggauuccagugaggauagugauguuccuaaaagcccaaauggccuaugcaaaaguauuggagagccuggcgugcuggcuggcucugaucuguuuguaaucccagccuuugggauguagaagcagcaaaaguucaaggucacccuuaacaccguugaguucgaggucaaccugaacuaaaugagacccugaaaaaucaaaauuugggacccaggcgugguggcauucgagguaaaagcaggcagaucucugaguucgaagccagccaggcuaacauaagauccggucucaaaaaaaaaaaguaauaaaaauaaaaagggagagaggcuauaugaacugaaagaaagaccuggagaucaaaacagaaaacugagccgucuaagaaaugaaaauauuuaacuucauaguugcuggaguaagaagucuggaaaacuuugggcaacuaagguaaacaggucuagaaagacuggaauaguagccaucuacugguauuuugaucucuguuuguacaaccacaaccuacuauaguuucucaaacaguuccaaagaauaugucugggugaauugguaccacaccacagauuaacucuccuucagcauaucaacagcuauagaaaaccccagaagaaaugauuuugguugcgugucacuugguaggaugaaaucucgauuuucuagaacuaugcauuaauagaaagcugaaucuucauguucugacuuuacagagcugcggcagcauggaucuaccgguggaugaauggaaguccuaccuacuuaagaagugggcuucacucccgaagucugugcaggacacaauuucuacagcagagacuuugagcgacaucuuccuuccuucuucuucccuucuucaguaagugaauggaaacuucagggaaauuuuggucuggaaaauguucugccuugucauuuggucugaauaucucuuuuuuauaggagagaguagcuuuauauuuuuuauaguauggggcauuuagcaguuacuguugguuuucacguuucucccuagucugugauuauagaauggguaggcauaacugcuuuccucuuuugguauguguuauacuuaaguaauuuaguaucuugcugucgucccagugcugucacucaaaggauauggugcagguuguguagcugcccauagaagcucauucaguacuaauagugagaaagaacccuagcaauuguuuaguugagacccagaaauuuucaaauucuauggacugcauucacuggugagauagacauuuuauaucacaaccuaguaaauguauacauagguagaagucucauuuacucagcaaaucuuauuuuuuaauuuuuaauuaucugaaauuaaaauauaauuacaucauuucccuacuuccugccuccaaccuucccauguaccccuucccacuuugcuuugcucucucuuaaauucauggccucucuuuuuaaguuguguguguguauguguguauuccuaaaugcaaucugcccauccauaugauguuacuugugcguauauggcuucaggacugaccaguuuguuuuggauaaccagcuuggguggggcuugaaggguagaggaguguucccuggggaagacuaccccccccccaacauuccuuaguugcuuagaguucuuugucuaacguuggaccccuguaagaauuuuuuccccuuucagguuaaccuauauaaauaagacuuucaggccuuguucuugagacuucagaggucuagaaaugucccugacauuucuaggagaugcagucucaccucugacuuucuucuuccucugguucuuggaaucuuuccacccccucuuccuccauguuccccgagccuugggugcaagagugcugagcaccacaugaucacauguucaguaaauauuagugcucuguggcagucaagaacauuaaucccugcagucuggaggcagaggcaaaaagauuguuucagcagcacauauacuaaaaauuggaacaaaaccagucaaagaaccacacucaccaggaaaggaugugaauguggaugcaccgagcagggucaggcaauagcagcgagguagccacgcccgcuuaggcuucugacccaccggacugugaggaucauaacuggcuguuguuuggagcugcucagcuuggguaguuuguugaacagaaguagaaaacucguuggcagaggcuugagugugaugugagcugauuauaucuucaaagagagaugaucaaacuaagccugcaggauaaagccauccaacuguauguuuuucuccuaggaccacagcuaaggauggcuuuuuaccagauaaaaguuugcaguugauuuuaagauaaagagcacuggccaugaacccuaauuaaacaaaaaaggacuuuuuuuuucuuuuuuuaaacaaagaaggccagugagcuggcacaggaaguaaaaugcuugccuuccaaagauacaagccugaccaccuacuguguaagccugaccaccuacugugcaagcuugaugacuugaguucaaucucuaggacccacacaaagguggaagcagaaauccaauuccacacacaugcuguggaauaugaauaaacacaaaaacacuaauaauuaauaaaaauaauaacaauaaucuaaaaaagaaacuaaucccacugcugccauuaguaaacuuacauuacaaaaaaaauacacucuguuauauuuuuuaguuuugucaaaagguuuuagaaaucucugcuauaaugaauaacuauaauuaauauccacuucuuggcuuucaaagccuaaguacucuaguuuucuacacggaaaguuugcugagcccugauuuuucuuuuuaaugauuuucaauuuaaaucucuuuuuacuucuguguauguguguguaccaugugcaugcauguacaugugcaguuuacacaugguggucagaggacggcuuuggagaguagguccuuugcuucuaccucguggguucuaggcuuaaccuuagaucaucagucauggcaggaagugccaccagagccgaucagucucacugguccugagcccugcuuuaaagaacugcuugucugcugugucaaggauaggcagcagaaggagccaggguagaagcagagaagcaguaaccucaauaagaaaauggacucaggccagcgugaguguagucaggggaggaagaagcauuuggacucugagguacauuuaauggcaauucuuuuuuuuuuuuuuuuuagauuuauuuauuuaauauaugugaguacacuguagcugucuucagacacaccagaagagguaaucagaucccauuacagaugguugugagccaccaugugguugcugggauuugaacucagaaccuucagaagagcagucggugcucuuaaccucugagccaucucaccagcccuaauggcaauucuugagaugagagguguuguguuguggagugugagagguaaaacugacccuagggagaagggaggagggugacauugccaaaucugggaaccgcagauggggaaaggagucacacuccguguuugaguugcacgugccccaaugguaaugucuaacuauguuuggaauuuaagagagaggccuaggauagagaaacaaaccuggggcguuuagagccagaaacugacuaagccuccaagcaagaguguguggcugcuuaccgcaugugcugugcugugacaauaugcccucugcuugccucauuuugaaaugcuaaucagaacccacuaaauuaauuucaugacccacugaaucaugaccugcaacuugaaaaaagcugaaaaaugucuaaagcggucuacagcaucuguggauuccccucacagaauuccaaaaaugguugggaacugaugaaaauauggcuaauaggcagacuuuggcuagauaaguuauucugguuuacuaacagaaacaugugguaaauaaacaggaaucaauugacuauuugguacauuggcaggaacaguuaauuaaagagggguguuaauguguaauagacgaguuccuagccuggugugguggcacacgccuuuaaucccagcacuugggaagcagaggcaggcagauuucuuaguucgaggccagccuggucuacaaagugaguuccaggacagucagggcuacacagagaaacccugucucaaaaaaccaaccaaacaaacaagcaaacaaaaaauagaggaguuccuucagauucuagccugggcuuucuucccuguacucuuuguauuuucagcugaggcacuuacauucagaacaaugacaucaguuuucucuggaaugucucuaaaacggaauucaaguccuaacuucuuuucugagucucaaauugauaaaucuaucauauccagaaacaaacacaugauuuuaccaucaaaaucagauucacuuccaguggucccuauccuagugaauuauaacagccuuagguucaguuccaaagcuggcaguuaugggccuguucuaaguuucauuucuauugcugcgauaaaauaucuuagcauaaagcaacuuggaagaggaaaagguuuguuugccuugcaauuccagggugcaguucauguuucccaggaagccaagacagccaucacaucuacggucaagaacagacagagaauaaacacguggauccuggcuugcuugccugcuugcucucaucaagcuuucuccucuuauacuucagaagacuucuguucagggcguguugcugcucacaauggacuugaucuuuccaugucaauuaacaaucaggauaaucccuuaugagcaugcccuuagcccacccagucacugagacucuuccucagacgauucuugguuaugucaaguugaugauugaaguuaaucaucacagagcuauucuguauugaaaaaccaaaugugugagccaggccugguggcacaugcuuacauugccagcgugcagaaggaucagaaguucaaggugauuuacaguggugaguuugagaccauagacuacaugagaccuuguaaggaaaggaaagggaaggaaagagaaaaaaaaaagcaaacuaacucauuauguucccacccccagccauuuuguagaaccucuucaugaacuguaccaacauuuguccaguuacaauucugaaacuggcugauuuuuuucuuuucccuugcacucuguaauaaaucuauuuuuuuauuauuuauuuacacuuuuugcaguggguauugaugccauauuucuucacauuugguaaaugggacgucugcuuccugauagaauaugauaggugacagcaagcaauacuccuaaggcaacucaaaauauucuaccauaacaaacacauuuuaaagacuucagacugcagcaaggucuagauagacuaaaauuucuggaaggaaagacugcuucuuagcagucguuagccauuuucuuuccuggggauaaacugcaggccaaggaugaggaugagcccagcaaagugaccacccuagagaaaacaaaagucagcagaacucuuggcaguugguuaggucuggugugauggauugacaaauggacaaauucaaagcccaaauacaaagucaguuuuccccaguucucaggaaugaaaagucaacuaaaaaggcagaauagaucugcaguccugcaguggugaggagcaaaaucucacagccagaagggacacugcagcaaacacaagugaucuccuuugucaagacauuugccagauguugaaugucugugauaugacagcuacagauccaaguccagaaccucuuaagaccaaaaccuggagaccuaaagaaaaaaagaguucuuuguaggcucucaaaggaaagcucaggaggaccauuugcaaggagcaguaaagaaccggcuguaccugccucagcuucacuaggcuagcagaaggaaacuugcuacguaaacaugaagacuuugaguucaaccccugguacccacauguauuagaauucucuaaggaaauagagcugauagaaugaauuuacgguuuugguuuuguugaaacagguuuucucuguguagcccuggcuggccuggaauucacucuauagaccaggccucgaaaucagagaucugccugccucugccucuugcgugcugggaguagaggugugugccacacacccagaugaauauguguauuaaaaugggauuggcuuacauaguauugucuggguaguccaacaguggcuugucugaauagguugcgaaucuaguagcggcugaguccaugaggcucaaugucccagcugggccagucugcauugaggacuccuggagagcugcuggucuucagucuaggauggaagcuugaagaauuugcuuguauuaucagcaaaggaauaccucaccaacagauuuauaauccaaacacaggcugagacaggaccaucaagaguucaaggccaugggcuggugcgauggcucagcauuuuacauuaugagauggccagaagucuuuggggauuaggguggaauaccauuauuugaauauaauuuaucaccccaaaggcacuuggugcauccaaccuuuaagaggugacuggaucaggaacuugguggaaacuuucaugaugcuauaacucuugaauucugcauaacuacaaaaccagucacaaaaugauaaugccaaguaccacagccaugcugagcaguaguuuagccuuuuuagacauuggcuacuacagaagugaccucugaaugccugagcaguuaggaaggcugaaaugaauccaggauaaacaacuuucugggcagcucugagagcaguguacccuggugcucauuucuccaggggaaguuuucuaaguauuuauacaucccugagcacucggaaggcuauugcugauuccagaacuguccuuaaaggaacauuuuugguauuguccuuacuacaaaguacucuuuuggguuuuuguugugguuguuacuguuauuguugcuuaauugauuuuuguguuuuaaggcagguuuacacuauguagcccugucuagccuacugcuugcuaugcgaucucaaacuaauaauccuccugccucagccucuggagugcuggauuauaggcaugcaugaccaugugcagcuguagacuucuuucuuuuuauuauauauauuuucuuauuugugggaggcauauguguggaggucagaggguaacuuguagaaauugguccucucccauuauguguguccccagagauaagcuacaguugucaauauuuuugggaaggacuuucauauguugagccaucucacuagcuccaauuuugcaguuugguuuggacugaggagagcuguuuggcuauuugaggucauggggauuaaacccaaagccucagaaaugcuuuuuuaugguuugguuuuguuuguuuugaaacaggcuccuacgauguagcucuggcuaaucuagaauuguauagcccaggcuugccuugaacucacagagaugaaccugcuucccucuuacgagugauggaauuaaaggugugcagcucuccuggccagcguuaagcuuuuaaacaacuguguucuccuuguccacauccuggaacacacuccuauugagauguguuccuuguauuuuuauccccuacaaacuggugguuugauacuugguuccuaucugguaguguucuuuuaauaaacuguagauccuuuaagauguagggccugacggacagagguaggucaguggugguaggccuguaagacuguaggcagcucucuguuuccuguccaccacacaaugaacacuuguccuuucccacacccuccugccagcagguugagcuguuccaucuugucuucccugaauuugcugagggaaacccccugaacccaugaggcagaauacauuuuuccucugaaguaguuuugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucaugcaccuagugguguagaggagaaucgacgaccagccaaauuuuuuacaggcuuauauaguaaaacucaaggggggagagcugggcagggaaaguacaaguuuacaucacuaggggguucugucaggggacaagggguucugccaagggaaucuacguaacuaaggggucauguccuauuauuuggcaauguacccgguucauuuugcgguuguuuuaggaggcccuuaucucaaaaauguucuaggaacaguuuuuaguugggaggguucgaacucuagggugaggaguucaggaaugcauucuggggugaagaguucaggaguguuccgggaacaaucucuagaugggaggggucggguucuggggugaagaagaguucaguaaaaauuuuuauucuucauuccccacuucuuuuaggagauagcucuaaucuuagagcgaguuuucaaccuccugaaggacccgauauuguugccuuaguaccauaaccuggacugcguuuauccuuuuucuaauaaaagcuacuaacuuauuaaggaugcagggcccaaaaguaagcaaaagcauaaguguaauuaaagguccugcuauaguggagaggagaguggugagccaaggggacuuauuaaaccagcuuucaaaccaucuuuguuggcuuuuucuuucucuuuuacguauaucuaggcguucucuaaguuuagccauagaaucuuugauuacuccugaauggucaacauaaaaacaacauucuucuuuuaaggcagcacagaguccucuuuuuuuaaggaauaauaagucuaauucccuucuauuuugcagcaccacuucggacagggaaguuaaagauucuucuaauuugguuauagacuguucuauaguucuaagaucaauauccauaacugcacguaguucuucauaguauugggggggucuuaauuaaggcagcgguuccuguaccuacuccagcugcuacucccaauccuaauagaacugccaaaguuaagguaacggguucucuuuuucagcggacccgauguucaaauuuaucuaaaaaagaacuauuaucaugauacaagagucugggaauaagcugaaccaaaaugcagaaaucuuuggaacuauuaaaaacagacauagacacacaaggagugagaccgguauugcaagcccacacugugucuaggggaggcaccagauacugaccgcuuuugcuagacuggauguucugggucugauuacagaggugcccuuuauccugagguacccggcccagacaaagcccucuuccugaaacugcugcuagagucaacuuucuguuuuuuccccaaaggcauugagaaugaucugaaguaguauuauaaguccugaucugagcuauuccuuuauaauaaggggggcuagaggcauagcauaaccagcaugauugagucauauuaggguuaguucuauuuagaacuaaaaaagcuccuuggacuagacugaccagacgguccucuguuccuaggggcgguggggaagccaagguaggcuuuaugaggagaguauuaguuccuagggaggguaccacuguguugggcuguggaguugguggagcugguacagucgggaccuuugggggagccaguacgacuggggggcccuguuuuauaaggaccuuguugggcccuacgagugucacugccgggucucucacugucaaucugaucgugaaaaugaacccaggaucucuuaguggaauguauacucgccaaccccaccuauuuccuuuaagccaacuuagacgguguuguuuuccguucucggugaaccuuauacguaggggguuacaguauuuaucuuugcaugguccugagggugcucuguuuuuaaaagcgcacccacucucuugauauuuauagggguuucuuucuccuucguuugacuuaucauagccacuaccucguuuuaccgugauuaggucccauuuagaggagggcuuccaguaagcaucuccugucguuucacauguccauuuaccacaaaaguaaucugaugcccccccgcauuuuuguugaagccuuuugcucugacccugaccagggcaaacauaaaaaugugcagcucuaagauuagcucgguagaacugccccgaacacccauaugugcucccuaucccauuugggacacaccgcuccucaggggguggguugcuaagaucaguaugaucugagaggucccaauugggggauccugccgcuaacuuacagaugucaggcgugagaucaggccaccaaauccagaggggauggacugcagugguugcccauacaauguuuuccuuuucauuaagcaccucccaggacuguugaauuggagcaugaggguuaagguucccuaggucuagaguggcgccugcggcgcagacgaagcuuaagaggauugucagugacugccacuguccaauugucgucgugguuuucuucaucuugacuggcggcccucuugacgugggaggcguggauccaggaggcgauuccgucaacuuuuaccgcaguagggguugucaguaacaccaaauagggucccuuccaccguggcucaaggcuaccgguucgaugccgucugaccaagacuuugucuccaacucggaacccgugggguacugcgguggucccugggguauaggcugcuuucaguuggucccaaaucuggguccuaaucacuuuuagggccuuuaaaugaauaagcaaagaggaggguaagacagggucagagucggaaacuaauguuccaccagcuuccauuaaggggggagguccuccauacagaacuucaaaaggagugagcccgaaacgaccagggguguuugagcgcaagaggaaggagagccacccagucuuuucugccggucucaauggcuaauuuagucaaggucucuuuuaagguccuauuuaucuucucuaccuguccugagcuuugagggcgguaagcacaguguaauuuccaaucgaugcccaacugaguggccaagcccugacuuaccugggcaacaaaggcugguccauugucggacccgauuaccuuagggauuucaaaucuuggcaggauuucuucaaggaucuucuuggccacaaucugggcagucucuguuuuagugggaaaugccucaacccauccugaaaaggugucuacaaauacuaacagauacuuguuaccauacauuucagguuuaacuucaguaaagucuaccucccaauacacuccaggauggucuccccguugucucuuuccagguucucuguaggcuuuaguugcauuagugaaugcacaugguuugcaggagucuauaaucuuuugagccacugacuucagguuggggacuugguaucgggaauuuuuaauuagucucaucauuuuuucaacucccaggugggugaauugguguaguccuuuuacaaauuuuauuccuucuucgggaguuaauucuauuuuucuuucaaaaaaaguaugggaggggaucacuggucuaccauagcucuuuuauguuauaccucccauccucagggcuuuugggcggaucaccuuuuucaguuaagaucauggccccuugagcaacuuguuuugccacuaagucugccauucgguugcccuuggccaccaaguuuucuccuuuuugguggccggggcaguggaugauggcuaccuuuuuaggugcauguauggcuucuaacagggccagaauuuuuucuuuguuuuuaaugucuuuaccagccgaggucaauagcccucgcugccuguagauggccccauggaugugugcgguagcaaaagcauaucggcugucaguguagauauuaacgaucuuaccuuuagccucucggagggcuuguauaagcgcuauaaguucagccuuuugugccgauguuccuucaggcaaagcgcuugcccaaauuaccuuuuucccgucuaccaccgcagcuccagccuuuugcuuccccucuaucaggaaacugcugccguccguguaccaacugggagcucuaggccaggguuggucagucaggucacuucuggucccaguuucuucagcgaggauguccauacauugauguacugggacggaaucauuuguuagagggagaaggguagcuggguugaggauggcagggggcgcaaagguuacacgcucauuuagcagcaggcucugauagugugucauucgggcauuugucaucuuaucugucagguggcugucgcacgauacuuucuaaggcaugaggggcuacaacggucaccugcugucccauugucaguuugucagcaucuuugaucagcagggcuacugcugcaauagcuuucagacaugugggccauccacuagcaacaggaucuaauuuuuuugacaaauaggcuacaggucuuuuucagggucccagugcuugugucaauacuccccuggcuacacccgcucucucguccacauauaggacgaaaggcuuagucaagucugguaaugcuagcgugggggcagucauuagagacgacuugauagccucaaaagcucuuugguguucuucuuuccacuugaaaggaaccccuuccuuagucaaaggauauagaggugcugcuaggguugcaaagccuggaauccagagucuacaaaagccagcaguccccagaaacucacguaccugccgugggguaguuggcgaugggaucaucauaacagucuuuuuccgggccucugugagccaucuuuugcccccucggaggguauaccccaggaagguuaccucaguuugacagauuugugccuuuuuagccgaaacucgauaccccaagucacucaguucugugaggagccucucaguucccuggugacacagcuccuucgaggccgccgcgaccaagagaucaucuacauacuguaguaggguaagcugaggguuucgagcgcgaaaaggcgcaagaucccgauggagggccucgucaaacagggugggggaauuuuugaaccccugugguagccuaguccaaguuaguugaccagucuguccgcccucugggucccuccauuuaaaagcaaacaggagcugacucuuagggugcaaacgcaggcaaaagaaggcaucuuuuaagucuaggacuguauaccauguucucucaggugggagagagcuuaauaaauuguacggguucgggacuguggggugaauguccaggacccuuuuguuaaccucccggaggucuuguaccgggcgauagucauuggucccugguuuuugaaccggcagaagugguguauuccagggggacugacaggccacuaaaacuccuuggcccagcaaccucuggauaugaggccggaugccuuuucuagcuuccuugcucaugggguauuguuuuaccgaaauggggguggcaucagcuuuaaguucuaccacaaccggaggcacuuguuuagccaaccccauuccugcuuguucugcccagacauuggggaacgcaguuagccaaccugaagagacugcauuuuuggguuguucuucaugcaaccgguacucuuuuucuguguugaggacaaggcaggcaacaggggccuuuccccagcuuacuugugggccuucugaaguaaauuggacuugagccuuuaguuugguuagcagaucgcgccccaagaggggagcagggcacucagguaucaccagaaaggagugggucacuauauuuuugucuaucugaagagcucguuuggucguccagggguaaaauuuacuaccaguggcuccaauuaccauggucuuuuuggagccuagcuugccuaggggguuagugaguacugaauguucugcuccggugucuaucaggaaguugacgggaguccccuccacggacaaaguuacccuaggcucagggagggggucugagccccgacuucccuaaucaucuucuaggguuaggaccuuggaucgcucccgcuuuuuagggcaaucucuagcccaguguccuuucucuuugcaauaggcgcauuggucuuuuuccagugguaucuuuuugccaccuugcgguuucacugcccuguugcccaggagcccuauuuuaccuuuuccugacugucuaucauucacaacugcggccaaaauuuuacucagauuucucuccugacggcgaucccgucuauuuucccucuccucuauuucuuucuucucucucuccugccucucuucuucuguuucccucuuaugauagacuuuuucugcuucuuuuacuaaaucuuggagcguaugaucuuggagccccuccagccuuugcagcuuuuucuuaaugucgggagcggacugaccaaugaaggccauggcuacagcggcucucugccccucugacaaggggucaaaagggguguaucuccuauaugccuccauuagacgcucaaggaagacugagggugguucagucugccccugcaagaccucucuuaccuuagccaaauuggugggccgucuagcggcuccucugagaccugccacuagaguccggcgauagacaaggaggcguccccuaccuuccgcgguguuguagucccaguuggggcgguucaaggggaaagccucguccacgagguuagggagggcagugggugugccguccucucccagaacauuuuuucucgccucuaugaggauucuuuuucuuucuucuguuguaaaaagaaccugcaaaagcugcugacaaucaucccaaguggguugaugggagaacauaagugacucaaggagcccaguaaguccagagggguucucugagaagggagggugguuaguuuuucaauuauauaaaucagaagaggaaaaaggccaguacuguaaaggaaugagaucauuagguccuggugcuggcccucucacaugugcucugaguggcaaggcaacuguugagucuggccccccuuccuccccggggcuucggccucggcgacuccgagucucccccgccggucccugagccccucucgcuauuggucccugugguggggcagcugcagguggcuguuggggcaggggguaagggggagguugggagucuauccagaggaggucgucaaucucuggauagaucuuggggggugcugaugggccagacuuuccggcugcaucagacugggcaaccgcgaccgucaguuucgaagaguuugggguccaaggcuugacccacggaggugggaauuggacgagauucugccaggucacaauguaggggaucugaucagggugacccccuuccuccugaaaaacaauucgccugacggcagcgauuagugacaagucaaaagcacccucagguggccagccuacucuaaacguuggccacucggaggcgcaaaaggucugccacggacccuuucugacuuccaccgacugguugugggcucugacccgcaccuccuuccaaugcuccagagucagagaaaggggaguggacacagauugucccauuucuagaaaaacaguagacacaacaagagcggacacgagacuaagacaaaaaagaaaccagaaacggcggcgacucugcgucgaccacaagcaacucaaagaaucagauggccuuucuaaggccggccgauugagacccucugcacgaggugggacucgaacccacgaucucgugaccaaacgcgaggugggacuugaacccacggucucgcaacaaaacgcgaggugggacucgaacccacgaucucgcaacugggcacgaggugggacucaaacccacgaucucgcaaccccaaauggucucuuggccuccaaagggguccaccaggcgucccugguccuccccuguuuuuccugggacgucucccagggugaacggacgguggacaccuggacacgucuauccuuauccaccccgcguucccucucggagcgcggucucacugagcauccgcaaaaccgaaacugcgaucgcaccaaacuuagaaacagaacacaaacaucagaccaaaacagaacaaagaaccuuaccucuaagugggucuaggaccucuggguggucgcgcuguuucccggccaaugcaccaaaaugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucaugcaccuagugguguagaggagaaucgacgaccagccaaauuuuucauaggcuuauauaguaaaacucaaggggggagagcugggcagggaaaguacaaguuuacaucacuaggggguucugucaagggacaagggguucugccaagggaaucuacguaacuaaggggucauguccuauuauuuggcaauguacccgguucauuuugagguuguuuuaggaggcccuuaucucaaaaauguucuuggaacaguuuuuaguugggaggguucgaacucuagggugaggaguucaggaaagcauucuggggugaagaguucaggaguguuccgggaacaaucucuagaugggaggggucggguucuggggugaagaagaguucaguaaaaauuuuuauucuucaguuuccauaagguauuuuggucauagcaacauaaaaagcuaacuauaaaaacuaaguuguauaugaagaaaccuccuucugccaaaacuguccuuucuacucugcuuuuuuguucccaauucuuaauauaaauccagcuaaacguagcuaguaacaguccaaccacagccuuggcugccuuaaaauucacuccaguguauuaauccaucgcucagcccuccacagucucaaggcauggcaaaauguagucgaguccuuugucacagugucacaggaaugacucuaauccaacucccaagaaaaugcuuauucccaucugaaaccucaagagcacauccuuaacucucugcauucucuucaccacauggcagccagcugucucaggauauuugaucguauugugaacccuaagauucuguuauuuauggagaaaaagaaacuauuucuagcuagaguuggcucagccuuauuagcacacaucuuuacucucacuggcugaaaaagagacacacccuuaguacucaccuuuaauuugaaacaaugaagguaaaguugguuuguagaggaggcacuccugcuugaaagugaugucuaauugaguggcagacaaagugaagaaucagagaaagguuugacaggauaggaucugcccaacccucaggagaagagagaggaaagggaagcuacguaagggagacacaggugguaccggagaagagagugcagcacaggauacaggagagcuguggagagcagugcaguagagcugagagggagaguagagcggcacagagggggaggaggaggcagguuuaccgggagagcuuuacagagaaggauggaagagagaacaaacuagacacaguaaagacagaacaagcaagagagugugaaggagacaagagauuagaaaagauugcuagaguuaguuugagaccaagcagagcaauucagaggccaagagaaaagacagauugugaauaaaaucaucggggagaggaguuugagccggaacagggggacugaaucagccagcuagaguucagaaagaacaggaaacggugaucucagcagcaaguccuaaaggcuggaacauucuaggcuuggauuagauuguauggaagcuagaagcuuccagggcuaggccuagguuagcugauggagccaguaagccuccaagaugacaguuacaucagucaaauaaauacuuuuacagccaggaagcggagaaagggaaggaucaaggaugagguagccucuccaaggacaugccucuggugacaaacuuccuccaguuaggccucaccuuguuucugccuccuggaaguguugccuucagauuauuaaucuaucaguuggucaauccauugauuagaucagagcauuccugauuuaguuacuuccuaagaguaugaacucugcauugaaccuccaacucaggaauuuugggggaacuuuucauuuauaaaccauagcacucugcugguucuuuucaaagauauacagucaaagaguuuucuauucuuuuuauguguuuauguauguuuuacauaaauacacuauauauuuuuuucuuuauucucuauucaauuucauugugugcguuguucugcaggggcuuuucauccucacaccuuaaucuucuuaauagucgugugauagaacgagaauaguauaaaugugucccaauuuguuguucuuuuuccuacugaugagcuauuaaguacuuuuuguuguuguuugguuuuguuucacuguugcaaauacugcuucaguaaacaaucuuuauguguguuuuugagcacaugcuuaagaaguucagacagacucuuagagaauugcuccacccaugguuauaggcaucuuaagaugaauagauacuaccauaugcauucagaaagccuuugucagcuuagcauaagcaaugccugagaggucuccaacauuccaagcagcuguccuuccuuggguucaguccccagaaccacuaaauaugaaaaacaaaggcaaaaagggcugggguuuaaucuauagcuuucugaucacaagggaaauaguauuccuuuucugucauuacagcucauuuguguuuccucuguaaguucaauuugcguccuuuguccauuuuguuagugguucaucuuacaucuaccuauaagucuggcuguuugaauauuugauauacuguacuauguaugcuacugaucuuucugguuuuuaaaaaucuuuuaagauuuaauggugucuuucauuauacagucauauguauauguauacauccauauccacagguucugcaaaccuagauucauuugaccuuagaugaaaaauauuaaucagggaaaagaaucccggcaacuccucagaagcuaaacuugaauugcaucacacuguacugaguccauguguaggcacaccguuauaacuuccugcuugacacacaugcucuauccagcacucugugucgucugagcauuauucucugcaucugauuuuguuuuuaauuuuuugugucugaauauuuuaucugcauauguuguuauguaccguguguaucagguauccaugggggcuggggaaaguugacagaucacccaggacuggaguuacagaguauugugagccacaacauggggcuugggaauugaaccuaggugcucuuaacccccuuauucucuacauuuauuacagcauuugugauacauguaaguagcccuaaaaugcaucuguacuagacauguaagcucuuuugucuuguccuuaggcacugaaccauaugacauaacaacuacguauaugguauuuauguuaccuuagguauuauaaguaacauauagggccaaugguagagaucucaccuaacauauguaaaagccuggucuuagucucuagcaccaucacccccccacacacacacauguuguauagacauguuguaaagaauaaacaaggauguacauauuacaugcaaauacuaaaccauauuuuauagggacuuaagcacuggcaaauuguguguguguguuugugugaauucacacaagcauaucuguuauuugggcuggguuguguuuuuuuaguguauuuuuuagauuuauuuuauguaugucuguguaucacaugugugucuggugcccacagaugccagaaaaggacuuuagacccccuggaacuggaguuacagauuauuguggguaccaggaacugaacccagguccucugcaagaggaacaacugcucuuaacugaucggucuuucuagucucuugguugguugguugguugguugguuggcuggguuuuuguuugucugugcuuguguuuguuuuuuguuuuuguuuucuauguaaaccuguuccagaacuugcuauguaaaacaggcugagcuugaagccauagucauccugccucucccucucuaguacauaaacuauauguagguauauaucaccauacccaccuuccgcguuuguuuaagauaagguuuugcuauauaguccuugcuggucuaguauuugucauuuagcccaggcugaccucaaacucauagccauccuccucccucagccucaaacacugggauuacuagugugcaccacauggcuggcuugucauuuucccuuauuguuagcauucuguugaagcuuugccucacaguuaccuggcaacagccaggcaugcuugacucacuauaaaagggccugcuugcccccuccucucucucuguuccucucuugcuuuugccuucccacuccugcucuguccucuugucccuccccccccccccaccacaugcuuauggcuggccuauacucaucuacuguucuacucucuuucucugccuuucucuguuucuacuacccucuuaacuucccuccccagacccuuaguaaacucuauuuuauacuauaccauuguguggcuggucccucggggaaaggaugccucagcaugggcccaccgaggcacccccuuccccacaccucagcucaccuccauauaacauauccccccucuauuuaucuuuuuauaaacacaucgcuuacagcuucugaauuauaugucuugcuuauuagaucuauucuacaucaagauuauagaaguguauuuucuucuaaugcuuuuggauaguuuuauacuuucaacuuuuuaauccauccaaaauguuuucuagcuuauuaacauauaauuaauagauuaaaauuaaguauaucuaagguguuaucuuagucaauguucuacugcuuuaaugagacaccauggacaaggcaacccuuauuuauaaaagaaaacauuuaucugcggcuugcuuacaguuuuagaggcuuuaguccauuaucaucauggcagggagugugguggcaugaaggcaagcauggugccagagaaggagcugagaacuuuacauccugacccacagcaggggagggagggagggagggagggagggagggagggagggagggagggagagagggagagagggagggagagagagagagaaagagagagagagagagagagacuccuucaacaaggcuccaccuccuaauccuucucaaacaguuccauucccuggugacuaaguagugaaguccauucucucucaaaccacaaugugauauuacaauaugcauacacaucugaaauuaguauuuauaugauuggucaguuuuugucaacuugacacauaccuagacauacgagagauguaaucugaauugaggaauugccuuuaucagaugaaauguggggccauuuucuugauucuguugcuguaagagagccuauaccuaggcaggugauccuaaguauaagaaagguagcugucuaagccugggcauaagccuguaggccaccuuccuccauguuccugcuccaguuccugccuccagauuccagcuuaaugaacuccuaucaugacuucacucaaugauauacauuuaucaggacucguaaggcaaauaacucuuuccuccccagguugcuuuuaucacuguuuuauuacaacaacagagaacaaacuaggaugguaauuuaccuuuuauuuauuuauuuuugagccagacaauuuucuacaguguuuauuaaacgacccaucuucuucccagaugccguucuuacugaaaauuaaguuacugcuuacuuuuuaaauuuguuucuagauucugugugccaaaacaaagaguuuuaauuacuaugacuucauucauuuuauaauucuuggaguuucagguuaacagaaacccaccucaaauuugaaauuuguaacuaugaaaauacuaacauuuuuaaaagcagauauguauuuggaggcuuggaguaugccgggaaacuucauauuucuucaacaaccaacagacuuugcauuugguaaugcuauacccauucuuagcccaggauacauucauagauuacuaaccccauagaaggagaccuuccuucuggagaguuucauugaaaaguucgaggaagucuuuauuuucuuuuucaagagaggguaacacuauguagcuagcccuggcuguucuggaacucacucuguagaucuggcugaccuugaacucauggaggucuuccugcuucugucuccugagugccugggugggggguggggugggggagguaaagcuguuggccacuauguccagccuugggaauagaguagccuaaccuugaucucccucauagcccuuuggucaaagauccucaguuucgacuuugauuacccagacuuccuguuucucucauggaacaguuucccccugagauuuacuaguggaagaaaggcacucaaaaagcagggagcccucguacaaaugagacuuccuagcuauauaauuaggccgagaugcacacauccacagucauuacccuucuucagagccuuugucaugucaaguguauuucgcccaugugaacuuuagaacuggcuuguuguguuucauaaaaaguguaguugggcucuugauugggauuguguuaaauuuauagauucauuuagggagagcugacaacuuuacaguauuaaauguuuucauccgcggaaaagguugucuugccacuuacuugggcuuucuuuuaugcccuuaaguaaagguuuauaguuuucuuuauaucagucuugcacauuuccuguuagauuuauuuuugcuuguaagguuuccuugguugguauuguguauaaacauuuucucccaauuacauaccauaauugaugguuaggaguauaaauaaaagguagaauuuuaaaauugcuguaugaaugacugcuuugcuauaauucaacaucuuuucauuuuuaugccaaucuacuugacauguuuagguuaaaugaugauaucuguacagaguaauccucugauccaguauuugcacaucuuacuuucuaacguccauagcauagauacacaucuuauacuguugaguacauauauauuuaagguauuuaccauagucuuauaauaugcagcgugcuuugguucaagacaguugcccuguguuccucaacauuaacauuuuuuucaucacaaauacacauugaccuuuaucaaauuuuuaaaacuaucuugagagaaaugaccauuuuucuuaaucuguuaauguaaaauuuuuauaaaaauaguuauaaauaauauuagccuacauauuucuucuguucucuuuuucaacucuuagaaucagaguaugguagucucagacuaaaccaggagcuuccuaucuguuucucuguucuuaagucacuuauauaauguaaggaugcuguguauaucugccagcuaggccuuauauacaaaaggcacccaucacaaccuucuaaaacagucuuaccacuuagagaccauguucaaacauaugggccuuugagguaauugccacauucaagcuauaauauuguuaucuaagggaauaucuucacuucuagcagaugccuaaaaauaucuaaagguaaacacugguaauugcuguguuuguugaugcugcucuuccuccuccuccuccuccucuuccuccucuucuuccuccuccucuucuuccuccuccugcuucuccuuuucuucauccuccuuucuuuucuuauuuuugaggcaugauuucaccauguagcccuagguaacccguaacuuacuauguauguagaccaggcuagccucugucuccugagugcucauauuaaagguguguaucaccauauccagcaacacuugcuuugagaugguuagaggaaaaaaaaauauacguaaauaaagauggaugccaauuacuaaauuguuacuuccagucaaacuuuguaccuagucuaaggccaaaauagggauuuuuuuucuacuuugcaaguuggcuccauuaagaggcuuuucuucucuuggucucacuagauaggaaggagagagaggagggaaggagagaaagcgguugaggagugggagguagugugaccgagaauacccaguaggcucauauauuuaaauauuuggucccuaguugauagaacuguuuagaaagauuaggaagcaugucuuaggggcuuugagguuucaaaauuuaaugcuagacccagucuuucaagggagggggcggucugucucucucugccugcugcaugcagagcucucagcuacuacucuagugucaagccugugugcuuccugccucaaugaucauaaauuaacuguaagcaagccuccaauuaaaugcuuucuuuuauaguuaccgugaucauggugucucuucacagaaauaguaaccuguggugauuuuaauaugccuggaccagggaguggcacuuuuaggaggaauggccuuguuaagaggaagugugucucugugggggugggcaaugagacccucguccuaaccaugugagaaccacucuucuccuauuggccuucagaugaagauguagaacucucagauccaccugcaccaugucugccuggaagcugccuuuguucccaccuugcugccccaauuaaauguuguacuuauaagaauuguuuuuggggggcuggagagauggcucagcaguuaagaguacugacugcucuuccagagguccugaguucaauucccagcaaccacaugguggcucacaaccaucuguaaugggaucugaugccaccuucuggugugucagaagacaggacaguauacccacauacauuaaauaaauaaauaaauaaauaaauaaauucuuuuuaaaaaagaauugcuuuggucauggugucuguucacagcaguaaaacccuaacauaacccugacuaagacaacaagugaggaaggguguugugugacacucuggaucucugaaagcucaccucagcaugaagcuugugaaagcgagaaaccuagagucacugcacaaccuccaggcagcucagugggcuggagaaugaaugccucuuggagccaggccagugggucugagccucuuccgugcagcagcugagcugaccugacaguaucucuucccaauccuuacagcuucuauaugcguagggaaggagggaccuagugccuccagucaguuucacucacuuacuagagcugcugaguauguacuuccuguguuuaacaagcuucccuguaggaugaacuauuucaccuccauggagcauccuauguuuaaggaacuucccaccauguuuuccucugaagaaauugcuacacaucagagguugagacucaaggaaagagaaauuuagcucuucguauacuaguagcaagccauauagaaaagaaugaaguuagacuuuuguacacuauacaaaauuaagugaaacagacaugacaaacuuaaagagcuaaaacuauaaaucucuugaaagaaacucuucaugacuggauuuggcagugauuacgggaugugucaauagcauggccauuaaaagaagaaauaaacugaauuuuagucagauuaaacuguugagaaucaaaagaguaucaaaagaauaaaaacagcccagaauggaagcccccaaaauggaagcaaauacuuguuaaucauuuucaucaggguauuaauaugcagagcuaaugaagaacucccacaacucaacaacaauuuuuuaaaacuccaauuaaaaaaacaagcaaauaacuugaaucaacaucgccaaagaagaugauacacaaacagccaauaaacauaugaaacgaugccuucccacauuaaugaucagagaaaugcaaaucaacacugagauaagauaccacuucacagucauuaggcagcuguuacucaaaaacaaaaacagaaaugguggugaagauguguagaagugggaacccuucucguagccagugggaauguaaaaugauacaaccauuguggaaaauugcuugaaaguuagagaauuauuguauggugcaguaaucccacuucuggguuuauaccccaaagaauugaaagcaggaugugagcagauacuugcacaccaguguucauagcagcauuuuccacaguaaucagaaguggaaaacacauuuucuuggugucuuauugcugugaagagacaccaugaccauggcaacucuuaaaacucucauuucaauggggcugacuuccaguuucagaaaguuaguucauugucgucauugguggcaugcagggccagagcagccucuggcugaggaaugagcugaggugaaacagaguuggaugaagacuaaagacugaugaucccuggccuuguaaucuuacugcuuauguguuaaguugcuuaguucucuagcucaaggacaucuugcuggccaagcaagaggccuaggacuugcuaacgcuuugugaaccagagagaaaagaaaaagaagaaaggaugaauucaagcacacacauagacauacaggcacacacauucugucuggggggcccaaccucucacuugucucaucaacuucccaaguguucaugcauacuuauauacauacacauauaccuaccuacacauguauguauauacauacauauagauaaacauacauacauacauacacacacacacauauuuauuuggguggauggagcagagcccagaugccacaccuuauuucuuucucucuguccuucuauaccuuuauagacacaaguucuuuagaaaauuaucucauagauaaaauuuauaaaaaggaaaguuacaguagaauguugauaguuaauuucaaagcaguguuuuauucuuuaagcucaaaacaacaguuuauccauggucuuguucaucauaucacacacuuguggcuucauccuuggaccugaucuagaaugaauauuuuuccuugaucacaaauuugucccaagcaugucucuuuuugguguaguugugaaagcucauuguauucuuuauuaugcagccuuuacuuacuuuucuuuuuguuuuguuuuucaagacaggguuucucuguguagcccuggcuguccuggaacucacucuguagaccaggcuguccucgaacucagaaauccgccuaucucugccuccgaagugcuaggauuaaaggcaucugccaccacugcccagccacauucuauucuugauucugacguuauuacaucuuucuggcaaaccaacuaaacuaucuccuaaagcuuucuuccuaaaauuauuuaaaucaaaucaggaauuuuauaaaaucauuuauucaucuaaacagcauuaauuugugaaaguucaucuuuauguugaucugcaggaaauaugcccaauaggaugggcuaaagcucaggagucauuauacuaaauaacagugacaagaaaaggcaugucguaauuaagcagcaauccugggaugaagucucuuggaaccuucccucucagagcucgccucucaaaagccaugcaaaaaacaguggaccaucucuggaaaaguugcuugccugcccuuagccuuuccuagaugacuccuaacaaugcagacaggcaugacgcuggagaaguggcugagagguucauauccaugucuguacauagucuucuguauuaacuguugucuccaaggcuuauuacucucuccgucugcuaaccuaggccuagcccuggaagcgucuagccuccaugcagucuaaucuaggucuaagauguuuuuagccucugagauuugcugcugaguaagcucaucuuuucuaguucuuucuggauucuguuggcuaguuuaacucagcuguugcugcucaaacuccuuuccaagcuaacugauucaauuugacuucucucaguuucugacuaaaaugcucugcuuagccuauuaacauuggcaaucuguccuaaucuccuggcuccuucucauucucuggcuuguucugucuucaccuguucuagcucugcaaccugucucuguacaaaugcccuggugaaaaccccuccucccucucccucugccaugcucccucuuaugcugccucucuuuccucucugcucugugacagcagaucuuucucuaauucaucacucuuaauuaaacgucacuuucaaacaugggugcuucuuuuuauaaacuaacuuuaccuucauuguuugggauuaaagguguguauuaagggcaugucugaauuccagccagaucacauagaccuagaaugucuuuggaugugaucagagcaaccuuguugcugggaccucaaagugacacaauuccugcaacaaggccacuccuacuccaauaaggccacaccuucaauucccucucuaguacugcuacucaaugacuaagcauucaacuguagaagccuaugggggcuauuuuuauuuaaaccacuacacacaugaaugccuacaaauacgugaauggauagugaaauauuauucagccauuuuuuuaaacagugaaauucugugacaugcaauaaauuaaaccucaaaaacuuuuuguuguuguuguuuuuugguuuuugguuugguuuuuuuuuugggggggguuggauuuuuggcuuuuuguuuguuuguuuguuuguuuuguuuugguuuuuuuugguuuuuugagacaggguuucucuguauagcccuggcuguccuggaacucacuuuguagaccaggcuggcaucgaacucagaaauuugccugccucugccucccgagugcugggacuaaaggcgugugccaccacaccuggcccuccuugaaaacuuuuuaucaagugaaauaagccaaacagacaaauaugcucuauccagcaaggcuugguucuggaaacgugaagaaagcagacauguguacuguuaggcuaggcugugcucucacugauggacagugucuacugugcuguaaccuggaaacucagcucauucauuguguacagcuuaaguaggcaggguagcuugguggacagucucugaagaggaacaaucugggguuacagucauccagaggagaaagcugugaucucuaguuuuuagacagacuaucagcauccucacaggaccagaggaaggcuuugccaauucccaugggucugaaguacagacaugucaacagaacacauucguucaggacuucauccacucccccacaauauuauaugguccuuuuguuuuuugagguuuauuuuuuguuugguuuuugcccggcauaugaucuuuuuauauaaggaccuauaguagggccagcaggauggcucugugguaaaggcacuugccaugcaagucuaacaaccugagcuugguuccuagaacccacagugggaggaaagaacuaacuccugaaaguuguccucugaccuccacaugcauaccauggcauacguuacaugcuuauacacacaugcaugcacgaaauaaauaacuguuaaaaaaaaaaaaaagacagcagugauagccagaggugguggugcacacauuuguuuucagcacuugggaggcagaggcaggcagaucauugaguucaagaccagccuggucuacagagugaguuccagaacaacacagaaaccgggccucaaaagaacaaaacaaaacaaaacgacagcagugaugguugcacgauaugauaaaugugcauaaucauguacuuauaaguugauuaauauguaucauauaauaaaacuugauuguuccauguuacuaguaagaauuauuuugggcuggagagaugcucagcaguuaagagcacugauugcucuuccaaagguccugaguucacaaccaucugucaugagaucugacacccucuucuggugugucugaagacagcuacaguguacuuagauauaauaaauaaauaaauaaauaaaucuuuuuuuaaaaggaaaagaauucuuucugcguguguguguguguguguguguguguguguguaugugugugugugaggugcaugcagauguguaugcuugcaugugcauguaacauggaagcuaguggaggaugucagguucucugccuucuuucuuucuuucuuucucuuucuuuuuuuuuuuuuuuuuuuuuuuuuuuuuuuuuuuuuuuuuugagacaggguuucucuguguagcccuuggcuguccuagaacucacucuguagaccagcuucacauuaaauuuuauacuuuaaggggcucagcgguuaagauuuuccauaggaaaagcgucugcuuuuccauagguccugaguucaauuuccagcaacuacauggcagcuuacaaaugucuguaacucaaguuccugggaaucugacacccucaaacacuaaugcacauaaaauaaaaauaaauaauuuuaaaaauguauacuuuugccgggcgugguggcgcacgccuuuaaucccagcacucaagaggcagaggcaggcggauuucugaguucgaggcuagccuggucuacaaagugagcuccaggacagccagggcuguacagagaaacccugucucgaaaaaccaaaaaaaaaaaaaaaaaauuauacuuucaugcucacuacuucagcaacacacauuaaaauuuacacucucagccacagugauagggaaugauauuuguucuaagacucaggcagagacaggaggaucucucugaguuugaagccacccugcucuacuuagugagauucaacuaaguaaaacaucugugggacugaagagaggcucggccgcuaagaggcuuugcuguucuucuuucuucuuuuuuagggggugggguggggauggguguugagacaggguaucucuguguaguauuggcugucauagacuugcuuuguaaaccaugcuggccucaaacucacaaaaaucuuuucgucucugcuucccaagcacugggaacuacaggcguguguugccaccgccaccugcuuuugcugcucuccuguaaaacuggaguucaccuccagcacccaugacaguuggaucacaaacacccguaacuccagcuccaggaaacccagcauccucuucuaaucuccauggaaacuugcacacaugugaugcacauauaugcauauagguacacauuaaaaaaauuaaaaauuaaaaaaaucuuuauuagcauuuaggaggcugaggaaggaaggguguagguaugaggccuguagggcuggagagguggcucagugguuaagaacacugacugcucuuccagagguccugaguucaauucccagcaaccacaugguggcucacaaccaucuguaaagggaucugaugcccucuucuggugugucugaagacagcuacagugaacuccuauacagggaaaaaaaaaaagguugagugcuggaggugaacuccaguuuuacaggagagcagcaaaagcagguggcgguggcaacacacgccuguaguucccagugcuugggaagcagagacgaaaagauuuuugugaguuugaggccagcaugguuuacaaagcaagucuaugacagccaauacuacacagacaaagacauguugagaaaaaaacaauuaaagcugagaguaguagcacugccuuuuaaguuggcaacacucccuggguggguuacaggacagcgagugguaauguggacagagagagguguucgcccuuauacagucuuagaugucacacaggaauuccugugcugcauuugcagaaaguuauuucaagcuaagaaggguuuuauugcacuucauuuuuuaaauuuaucuuuauuuuauguguaugaguguuuugucuacauguauguguguucacuguguauauaccuggugccuguggaaaccaggagaaggguauuggaucccuugggacuagagguauagcuggugguaggcuucuguguuggugcugggaaccaaaccacugagcuaucucuccagcccccaucuaucuauuuauugugagacaagauaucacuguguaucccuggcuguuauggaauuuacuauguagauaagaguggccucaaacucacacagaugccccuguuucucccacauccugggguuaaagguguguaccaccccacucagcaaguuuuuuuuuucaauuauuugauuuuuuuuugugguuauguguauacacauugauguaaaaaucagaagacagcuaguaggaguccuuuccuaccaucaucuggaugccagggucaaauucagguugcaaguuugcuaacaagugccuuugugaguugcuccuacacacacacacacacacacacacacacacauacacuuuuaacauccuuagugucguguggugguggugguggugugguauguguguguguguuuguguguguguguguguuaugugccuaugaguuuggagaaaaaaaaccuuagugucuugcucagguuaccgucucacugguggugauccuauugcuucagucucgugauagcuggcauuaucacggcugugccaugccagauccucacuuuuuaaaaaauauuuuuauuuauuauguauagauauagauaucucuauauaugaaugaguauccuguaguuaucuucagacacaccagaagagggcaucaaaucccauuuacaggugguggugagccaucauguaauugcugggaauuaaacucaggaccucuagaagagcaaucagugcucuuaaccccugagcccccucccuuuuuuuuuuuuuuuuuggcagcuuauuuuuaauuguuuuaaaucacguauauguuucuguauguagcuauguucacauaagcgcaggcacucauagaggucagagauguaagaugccuuuggagcuggacuuaaacaugguugugagccaucugauaugagcaccaaguggacuuggguccucuggaccgccuugcugccuuccaccuagaauuacaguauaugcaauuagcugcucagccacccccucaguccuccuuaguacuuucaacauaguguaaaucggagagcacuccuuggugcaaagauucuguguguucuaucauucucuacacccaggcuucauugggacgugugaugccagcgaugauucauuggcgugaaguaugaguuagagucagacaaucagugcucucugcucugagugggucucccugccccugugucucugagacaggggaggauucuccuguuggaucacauagugcauagagcccugugugcacagcgcucucaaccauuuguugccauuucaaauacagugacuucagagucuuccuugaaauaacagauuucuccauuuuguuuguucccuucuuucgucacaaagaccugaggaugagauguuuuugaaggaacuuucuaguaguuacucgguggaaaaggacaaugaugcuccccucuucuacagagaagaaggaaacaggaaauuccaagaaaaggaguacacagaugcugcagugcuguacucuaagguaacgugcguccaaccagcaguugaacaaggcggaagauagaggcaaagugcagacucauaaccaguccauuguuuugcuuugguuaguuggguugguugguuuguuuguuuguuuguuucuucuucuuuauuagucggauuggauuugggaaaaauguaguagaauucuauuguugauuauauucacaaacaaaagacuguuuauauguccugaauuuuggcaagauucuucccauauuccuucagacccauagcagcagcaagcuuaguggcccuuugccagguauucucacugagcuguacagcauuugucugaagaacugaugaacauuuuagcuuaugcuccuauguuaguaaauagcuagguuuuuagcuagccaccuugcuagcuuacaacuagaaugccucuggcugaguuugguggcacuugccuuuaguuccagcacucaggaggcagaagcaggugaaucucugaguucaaggcagccuggucuacauaacaaguuccagccuggccagggauauguaguaagacucugucucaauaaaguaaacagccagaaugacuuaaauauugcuaaaaaagaaagaaagaaagaaagaaagaaagaaagaaagaaagaaagaaagaaagaaagaaagaaagaagaaaaugaguggauuugccauagccuagucaaacuagauuuucuugguuauauguuaacauacuacuauuaacaacaacaaauacuuuacacuaaccaugacaagcuauauuuuuaaauuauuauuuuauauguauggugugggaagcuguugcagaguggcaguuggcuacugcuggccaccacacauacauaggcagugaagguucuuuugccaagacaaguuaaccaaucagaugugagacacgccucuccuaggccuauguaagcagcaccaguucugggcucagggucucuucgccucuacaaucaagcucucccaauaaacgugugcagaaggauccuguugcagcgucguucuuccuggccaguugagcgcgcacaagaguauggguuuucaccuacauuuaugugaacugcaugugcacuugguacccagggagcccagaagagggcaucauauccccuggaacuagagucacagguuauguauggguucuaggaaucaaacccauguccucuggaagaacagccaguguucuggauuuaacugcugagucaucucuccagccccaccaugauggauuuaacugcugagucaucucuccagccccaccaagcuggauuuaacugcugagucaucucuccagccccaccacgcuggauuuaacugcugagucaucucuccagccccaccacgcuggauuuaacugcugagucaucucuccagccccaccacgcuggauuuggaagcagaacugaggcuuugaacacuguguuauucuaacucuugcuuccuuggaacccugagaaaauuccuucuauuggcuuuucagagaucuguaugggcuuaaaacaagaauauguccaacucuugaucucugauuuuauauauuaaaagaauagagugagccuaggaguuuggcacacuccuauguuccaagcuucaggaagggaagaaggucaggaguugaaggcuagucagucuuagcuuugugacaaguuugaggcuaacgugagcucuaugagacccugucuaggagaggagaaagaaagggguaaagugagguguggcuccacgcuaccacuugccuaacacgcaugacgcccaagguuuccguucccagcccugggguucagaguauugugcacacccuguaucuuuaaaagucaauagucaacccuuggaauuaacuuuccgaaaaauauuaaagcuacaucauccacucuacaaacuuguaaaagcccuucuuuguaaugguguaagaaaguauuuggcuucaguuuuauggccuuugcauccuaaauguuaccccauggaaaguugcuuaaugaaaacagguaaaaauaagacaggagggacugcaaagaugcucaggcucacgagugcuuacugcccuugcagagaccauggcaggcagugggucucccuacugcagggaauccaaaacccucuuuuggccucugcaggcaaccacauuaacacaugcacacauacacauaauuuuaaaaauaaaauaaaucuuuuaaaaugagcucuagaacgaguuugacaucagucuaggcuacacaagaccuugucucaagaagaaagaaaugaagguuugcuguggauggagagggagaugcacuuccuauuccaugaagcugcuauuuuggugauuaugguacuuugcaauuuuauagagagcugcuauuuucuuucuuuuaaaguaaugcuuguuguuuugacuguaaaaguaauaaauguuacuuuggaaaauauagagaaguauaaagaguaaaaaaaaaagucauaaccagugaaguaccguuaacauuucugcuucuauccggccagccagaguuuuuccugugagaauguguuuuucuuuuacaaaauugggauaaugcugcacuuacuguuuuguagcccacucuuucccuucacgauuuauuguacccauuuucucacaguauuaaauuuucagcuccaaguaauuuuccauagcuaacucuguguucuguuacagagaagaaauguacuuaauuuaagaucuaauauuggcauaauauuuggcauuaugaugcuauaauaagcaucuuucuguauaaauauuuuuauguacagccaguguuuuguuugggaugaauuagcacaagaguaaaguguggggucaagccucugagugacgcugaauuguucucaggaaaggacuaguuaacauccauucugaaagaaugugggaaugcucauuucuuaagcaacacugguuauuauuacauacuauuauuuuguuaguauuauacauuuauuuagggggauaggaaauaugcucauauaguucaauuucaagaguugcaaaaauauauggugugguuucuuuuccuguccccuaguuuagucucacuuccagccccauaaucuaccuuguuaaauauacuguauauaaggcauauguaggugaauaaaaaacagccuaguaugguggcguuaaccucggguuacuugagaacugcucuugcagagaacaugacuuuggcuccgaaagccuuccuggaauuccagcuccaagggaugcagugccucuggcauccuuggguacgucacucaugugcacacauacacauuugguuuuuaaucuuaggaacuccaagugggccaaugagauggcuccauguauaaaggcaguuaugcaaaggucuggaugacaugaguucagucuucagauucugcaagauaacaggagaggaccaaccccugcgaguuguccucugaccucaguacacaugucaugguacguguguaguaugcacaugcacagaagucccagcacucgggaggcagaggcaggaggaucucugaguuuuaggccagccuggucuacaaaacgauuuacaguuauauaaagaaacucuguuuugaaaaacaaaacagggguuggggauuuagcucagugguagagcgcuugccuagcaagcgcaaggcccuggguucaguccucaacucuggaagagagagagagagagggagagggaaagggagagggagagggaggagagggaaaggaaggaaggaaggaaggaaggaaggaaggaaggaagaaagaaagaaagaaagaaagggaaagaaagaaagaaagaaagagagaaagaaagaaagggaaagaaagaaaggggaaggaagaaagaaagaaagacaaagcaaagcaaaacuaaauaaaauacauacaauauauuaaauuuuaagacuugagggcauagaucaguguuauaaugcuuaccuagcaugcguaaaacucuuggcuucuaaaccuagcacccuaccgcaaaauauuugcucugucuugcuaaauuauauugcuaguugucagacuacuguguacuuucacuagcaacauaaugagaauguucacuaucccacuccucugucaaguaaucuguucuugguuuuauuuuucuuugccaaauugaugggugaacaaguauuucagcuagccuagaacacacagagaacucucuuuaugaacucaaguuucuuauccuuuuaugaucuccagagguuuguuuuuguggguuuauuaguguuuuuuguuugguugguuguuuguuuguuugguugguugguugguuuugcuuuacuuuuucuuauucauuuuuuuauuucuuuauuuuuuuguuuuuaauuuaauggacugguuccauguggccaaggauagccucaacuuuguagcagaaacuggcuuugaacuucuggucuuccuucaucuaccucccaagugaugggauuaaggcacgugccaccacaucuaacaauaucuggguuucuuuauuggaguuugaaagggauuccuccagcauuacuuugacucuucauaguuucuuccagaguuauuacacuuucauuuguuacauuaagaguuugauccagggcuggagagauggcucaguggcuaagagcaccaacugcucuuccagagguccugaguucaauucccagcaaccacaugguggcucacaaucgucuguaaugggaucugaugcccucuucuggugugucugaagacagcuacaguguaaucauauaaauaaaauaaauaauucuuuaaaaaaaaagaguuugauccauuuacacuggacuucuugaggcagcaggaucauaaauucaaggugagccugggugaacuggcagaaguggcagaagcugugucucacacugcuguauucauuuccucauugaucuucagagguuugcuaacgggaaguaaguggaacagaagguucaguauucuuuuuuucccaauucuauucagucuuuaguaguagaucccucauuaucugagaugcagaguccccuuuauuccugugaccaucucguuguuuuucagggagugucucauucaaggccuaacacugaggacauuucacugugcuaugccaaucgcucugcagcgcucuuccaucugggucaguaugaagugaguauugaagaaccugguguccugccuguggcugcaguggaaaaugagcuccucucuguucuucugcacacauugaaaucaacuagcuugcaaacacugacauccacccagacccauucucucuucugacucaugucaccucucauaggugaccacaaacaauauguaguugacaagaaguagcuaugucauuguccacagugcauggauuuguuccaauaggccagcacuucuguguccauaucagcuagaugugcugcugauaguauuuuagauuccaaaauguguccagauauuaccuccuucguuuguuucuucuaaauaagccaggcacaaagacuugaaagauggcuugauggcucuuccagaggcuggguuugauucccagccccaacauagcagcucacaauaggcuauaacgucauuuccaaggggucugacuuccuguucuggccucuacaggcagaaagcacagacauacaugcaggcaaaacacauaaacauaauugaaagaagauauuaaauaauagcccacgcuugagcuuauuccucugaugauacagcucuccugaagucaucaugggcaguguaaaaguaaaggugccccgcccugcccaggggcaucagugagguagcugacugugaguggcuuucuucucauccccuaacugcugcaacaucaucaacuguggagcauuauauccguggauuuuaaguuaggaaaugacaaagauuagaucuauggccaggcacuagugcacgccuuuaaucccagcacucaggaagcagaaguagguggaucucugucaguuugaguuuacagagagugucuaggcagccagggcuauauagagaaauucuaucuggaaagaauaaacaaaucagaucuguauuucaggaagaugccuaugagcuguuugacaugugugauagagguccuuaaggacaggaaaguauuccacaugugugcauuuuacagaaauugguuauacacuggaguuaaggacuguuggaauaguugaauguucacacucaguguucuucaaaucaaauagaagaacaagaaucuaucugggcauggugaugcacaacuguauuccuaacauguagaagacugaggcaugcuauguguuuguggcuaaccugggcuacauagucaauauuggacagucagagcugcuacuaaaaccuaaaaaacaaaaaucuaauaaucugggauuuuauauuuuccuuuuuuuaaaaaaagagugggcagaaugucucugauuuuguucagauggccacagaaccuagaaaaacugcugcugcugcugcugcugcauagcacacagcuaauauuugacuauacguauauaaauuuuguuguauacuuuagcugugcugucaacuuuggaaaaaaaguaucccaguuuaucauuuuaaauuggcacuguacagaaauuaacagccauauuagucuagacacauuaaacuucauuuuuccauuuauacagaagcaauguacuguauuaaauauucagucuuaucuacagggguuugauuacagaaacuaucaaaguauucucuaaaugaugaaaaaagauucaagaaucugacuguagauccaaaggacaaguggagaaaaacuuaggaagaauuuucccuuuauccccucccuauauugaucaucucuuuuacuucuaauaauaguggccauuuauugaacauacccaggaguuccuuucaucacuuuagauauauaauuuaucucauccuaaaaugaccuguugaugagucaucucucuuucagaugagaaacaaagacauugaaaaaucuaacuugccugcauaagaucacaccuagccucuuacucacuccaugaauauuccuuuuuuuuuuuuccuuugagacagaaucucacuauguaguucugguuguccuagaacucaauauauagaccaggcuagccucaaacucacagagaucugauagccucugccugccgagugcuaggguuaaauggaugugucaccaagcccagcaaaauuuaccuucuuaauuuucuaagacguuucuccucuuaaaaaauggaacuauugagccagucauggugagacaggcuuaaucuuuaaucucagcacuuaggaggcaaagacaggccuauggguucggggcagccugaucuauagagagaguucuauggguuaaaguuuaggguuaaaguuuugagacaaaacuuugugucaaaaacaaacaaacaaagccagacugcuuaauaagacaaaucagacauaauauuauaaacaaguauuagugucacucaauuaaaaagucacucaggaggugagaucaauccccagcauaaugaggggaggaggggagagaaggaaaugaaugggaggggaggaggaaggaagagagaaaaaggaaagaucucaaagcagaacacaggauguaauuuaaggccuaagcucucgacugaaguuguccacuuuuaaugacccuuuucaugcucaugguuuucugucuucgguacauagugaagaguggaaaccaagggucauccuggaauuuccuuuuguuuucaggcaugucuuaaagacauaguggaagcagguaugcauggguauccugaaagacugcagcccaagaugauggugcguaagacagaaugccuggugaaccuggggagacuccaggaggcaagacagaccaucagugaucucgaaagcagccucacugccaagccaacccuggugcuuuccucuuaccagauucugcaaaggaauguccagcaucugaaaauaaagauccaagaaaaggagacucucccagaacccaucccugcagcucucaccaaugccuucgaggauauagcccugggggaagagaacacacagauuucuggggccucccucucugucagcuuaugcacacacccuuugaaaggccgccaucuaguugccacaaaagacauucucccaggagaacugcuggugaaggaagaugcuuuuguaaguguccuuaucccaggagaaaugccacgaccucaucauugccuugagaacaagugggauaccagaguuaccaguggagaccucuacugucaccgaugucugaagcacacuuuggccacaguaccuuguggcagcugcagcuaugccaaguauugcagccaggaauguaugcagcaggcaugggaccucuaccauagcacagaguguucucuuggggggcugcuccucacacucggggucuucugccauguugcccugagaaugacucuuuuagccagauuugaagauguugauagaguuguaaggaugcuuugugacgagguugguagcacagacaccuguuuaccugaaagcaagaaucuggucaaggcauuugauuacacaagucagggagagagugaagagaagagcaagauaggugaacccccaauuccuggaugcaaugucaauggaaaguauggaaguaauuauaaugcuaucuucagccuuuugccccauacugaaaagcauagcccagaacacagauucaucugugccaucagugucuccgcacugugcagacaacucaaagcugacagcgugcaggcccaaaccuuaaaguccccuaagcugaaagcagugaccccagggcugugugcagauuugacuguuuggggagcagccaugcugcgacacaugcuacagcugcaguguaaugcccaggcaauaacauccauaugucacacagguaagucagaaaugguuuuuacuuacauuauugguauuucaagagcuaauguuuaaggagaaaaacacuauaaaggaagccuggcaucaaauaaaucagugaccuaaaaggaaaacacagccgucuuauauaucauuaugcuauugagaagcuuugagcacauuucugugaacccagagcuugggagguggagauaggaugauuaggagucuaagacagcuuuagcuauacagcacguuugaggucagccugaacuacaugagaacuugucucuuaaaaacuugagccagagccagguggugguggcacaugcauuuaauucuaguacucaagaggcaaaggcaggcagaucccugaauccagccucgucuauauagugagauccccaccaggcuacauaguaagauccuguuucaaauaaauaaauauaacaaaaacagcaauaauaacaauagcaacaaauuaauuuuuuagauguauuuauuuauuuuauguaugaguacaccauugcuuuuuucagacacaccagaagagggcauuggaucccauuacagaugguugugagccaccauguaugugguugcugggaauugaacucaacaccucuggaagagcagucggugcucuuagccacugagccaucucuccaguccauuaauuaaaaauuuaaaacuagaguauuuuuaaacauuuauucauuuugugugugguauacauacuauaauacagguucauaagucaauucucuucuaccaugugugucuuggagaucaaacucagguucuuaggcaugggagcaaguauuuacuuccugaaccaucucccuagccauuucuaguauucuuuucuuuugucuugaaagauuuauuuauuauauguaaguacacuguagcugccuucaaauaccggaaaggggaaucaggucuuguuagagaugauugugagucaccaugugguugcugggauuugaacucaggcccuccagaagagcagucagugcucuuaacugcugagcuaucuccagccccauuuuuaguauucuuauuaagugguuuccauuuuauccaaagaugccuuuaagggccugggaagauggcucagugggcauugaacuuggugugugagcaugaagaccagaguucagaucccuagcacccaggcagaugcugaaugaugguggccugccugagauuccaggacaacggagacagacaggggcccuagcuaaccauacuacacacuagcugagcugugugcucaagagagcagcccuggcuuacugugcaggauggagagugaucaucuccacaggcaagcacacaccugagcacacagacaugcacaaaggaaagaaaaguccuuuuaaggugguggugguguuguuguuugggggucuuuuguuuuguuuuuuucucccccucccucauugugauggcacauuccuuuaaucucacaucugggacaaagaggccggaggaucuuugugaacuggaggucagccuguucuacauagcaagcccauuucagccaggacgacauagauauacccugucucaaacagacaaaaauuauuuauuuuauauauuugaauguuuugccugcauguaugucuaugcacauuaugucuggugcccaugaaagccagaagagggcaucagaucucucagaacuggaauuucagacacuuaucaaguacugccugagugcuaggaaucaaaccaaggucuucuggaagagcagcaaguagucuuuuuuuuuuuuaauauuuuuuuauuacauauuuuccucaauuacauuuccaaugcuaucccaaaagucccccauacccuccccccccccccccgagcagcaaguauucuucauugcugggccaucuccccaucuccuuuucuaguuaauuaagcugaaagggagggagguagauguugcccaaacuuaggauuuauugacagauuaauacucuguuagccuaacuacacuauagaagcuuauucuuuagacuuucacauuacacuguccagauuuugccauccuuuuuguguguauaugucuacagaucuuaauucagcugccaauuuauacaguguuuauagguauucuuugugacguggaucuuuuacccaucuuaaagcaguaggauuugaaagcugacauuuauguggccuaugguccuguuaaaucacauuucaaguuagucucugugguacacauuuuggggucuaucugcgguuccgcaucucacacuuuucccucucaggguguccagaagcugcugcacacugggcuggaaggaugaaguggaguccagagugaguggaauucugcagcaucccgguccagcugggagugaaugcuggggucaggaggagaugggugagagggccuucuccaagggccuucuuaguguuacagcucuaggcaaaggccuucucugacaaucuuagccugugcauaguuuuuuauucgagaugagcuuguaugcauacacuuuauuggcaguaaaucagagguuauccacucuuagggaaggagauaggaauacccaagguggacagaggucauuggcugaaggauaacguacugagaugcucauuagcacggggaggcaucccaggaaucucaggugcuugcugacuggguuucuuaggggguugagaggguagcagugauuucaccaagguuauguauggcagaggguauagggguuucaggcuccccagacaaagaaggagaaggagaagcccugcugauaagggaagucccccauuuugagccacuucagaaggcuaucaagacacugauagacuuuguccuuaauuagcagggcccaacaagugucuguuuucuuuucugccuucauuggcucuuugagccacugcuacaaaauauccaaaucugggccaggaagcuggcucggcuaguaaagguguuugccucuaagccugaaggccugaguuuucacuugauuugguuugguuuuuguuuuuuugagacaagguuucucagcauagcccuggguauucuggaacucacucuguagaucaggcucaacuugaauucagagaucugccugcuucuacaucccgagugcuuagauuaaaguugugcgccaacacugcccaccuaaaaaaaauaugaggggcuggugagauggcucaguggguaagagcacccgacugcucuuccgaagguccgaaguucaaaucccagcaaccacaugguggcucacaaccaccugugaugagaucugaugcccucuucuggugcaucugaagacagcuacggguguacuuacauauaauaauaaauaaaucuuaaaaaaaaaaaaaaagaacacuauucacaagguacaacaacaguguacuaggaaacuuuaaaauagcccaucauucauucuaggggaaaaaucuuuuuaaacuuuaguguguaagaaagagagaggggcuguagaaaggccacagcacguguauccagguuaggagucaacuuuucagaagcggagucuccccuucuaccuguuuuugaggcagucucuuguuucugcccuacacuuuguacaugaacuucaagaugguuguucuauuucugccucucauguugcccuaugcaugcugagcuuacugaugccagccaccacauaagcauggcaccagcacugagccaagggcaggcaucuggcucacauggagaguuacccaucaagccaucuugcuagccccagaaaauguauuuuugacaggugugguggugcacauauuuaaucccagcacucaggaggcagaggcaggcagaucucugugucugaagccagcccaguuuacaaaucaagucccagaauagccaaggcuacauagagaaacccuguuuugaaaaacaaacauccuucuguguuccagucacaaugacugcuguaacaauaauaugaggauuugggcgugucaaaaaucacaaguagcaagguguaaugggcaggccuuuagucucagcacuugggaggcagaggcaggaggaucucugugaguuuagcacagccagggcuguuacacagagaaacccugucucaaaaaaaccaagcaaaaauagaauuacaaguuaaccaggguauugguguuaauaugaaauagcagaacucaagauagcuaaugaaacaaaggauucuauuuuauaaaggagacauuccauacugaaauauaugcagagccugaugcuugccuagcaacugaacuacacccacacccucuucaugaaacuuaauaaaugcacacuaucaaacacauuaucaugacaaaaaugauagucuauauccucucucuaaaaguuaaauaaagauauauauauuugucuaugagauuggcaguaucauuuuguugauaucaugauuaguuuuuguuaaccuguuacaaaccuaggcaugucuuggaaaaaggaaucuuaaauuagaagaugccuucauaagauuggcauguagguaugucucacuaaugauugauguggaaagucaccgaggauggugucacccugggcagauggccugggguauauaaaaacacaggcugaacaaaccacaaagcaguaguccucaauggcuucugcuuuaguuucugucucagguuccuaccuugacuucccucagugaaggcaugucacaugagaguuguaagaggaaauaaacccuuuccuccccacauaguuuuugguuaugauguuauaugucaacaacagaaacuauaacuaauauaguugguuuucuuuuuuuguuuguuuuguuuuguuuugagacaggguuucucuguauggcccuggcuguccuggaacucacuuuguagaccaggcuggccucgaacucagaaauccaccugccucugccucugccucccaaguggugggauuaaaggcaugcgccaccauugccuggcugguuuucuuuuuuuuuuaauacauuuauaaugcauuuuagauuuaaaaaaaaaaauggccauggcauauaauauaaaaagaagugcuuacaaaucaccaugugcccuugccauaaauuauguaaaaauuuccauauggacaucagucucaagcuuacaaucucagcacucaugagccugaggcagaggcaggaggauggugagcucaaggccagcuuagucuacauaacaagauccuguccaaauaauaacaacaguaauaauuucauacauagaacuagaaggggccacugcaaagacaguaugacaaaaccacuggcccugccuaauuguauuuuaaauaacuguccuccucucuguaauuuucaguuucuaauuuuuacauaacuaccauguauucuuuuuguaauuuuaauuaguuuuuuaauaauagaaacaagcuaagugcuaagaauauuuucauaugaacauuuucaaggcacuugauacauaccucagauuugcccuccaggugagcaguaccaauuacgugccaccagcaauguuagcuuccuuuuuucccuaccaucugauucuguuucagucuauucguaguucugaucuuguuauaucccuuuuuauuguuucccuggguuccaacaccucccaguugaguguucucauugaauuucauuagcagcuguuucauuaauggcacagaagaaggauuacaguguuaacuaggauagacuuugacaaagaacuaugagaacauaucuuauuaucuuugcauaaauucuuuuuaaucaaaguuccucaaaagccucucucuguucccaucucagggaguaggucuggccacugaugaguguccaggccacaguacaggugugcgugguucugucccugugggaagggcacaucuguguuguaacaggauuccugucuuaacaagccuugcucaggcucuaagugguccugagcuagcuaacugcccuuggcuuucccuugauuaccagauaacuauucacucuucucauuuugcagagcacuuaccagguagcuauguccuggaaguacgaaugaguccuucuauuguuuuucuuuuacuuaaaucccauuugaaaugcgccagggacacuucaauccaagguacacuuuugcuaaagaaucacucauuuuuauaugcaaaaugucaccuauuaacugcagcugauaugguacauacauauucucucuuccuauuauccacuaauaggugacuaaugcgaaauauugaguaauuuuuaaaaaucaauacucaauuuuuuagaaauaauuagagagacauucaacucugacaccagcacccuacucaguuccugagccuuccucugccggaggagaaucuauaaauaacucacgaagcugacauuacucacuguguugcagucauuuuuuucugagaaaauuuuagcaacuguucuaauagagccugccaguuaucaguaguugagaaugcaagucaacuuuuaauuaugcagacgcugauuauucagacgacaaauuguuggugccugcacggcuccuuccugcugccuaccuuuaaccguucucagugcucauuagcacauguuccagaagguaggcuuuggaggggcggacaggcacucaaaccagcuaagcacuuagagaagcucugaugaaagauguuaaugcaguuuguagaauuauugacuaaaauugagucauuuggauucccugugaauuguauuuacaugcccugucccugucccccauagcaacagauaauaggauugucugcagagagacaacauaguucuuauauuuaauuuuuuccuuugucgaacauuuucacaugaugguucgugguguuuccuuuguucauuacauuuguauccagacuaguuacuucugauaagcgguuaguuaggauuccuggcacgcggacagugacaccacaguugucugaucguuucccacuuuuuuacaaaaccguuugccuuuaagagucaguguuuugcacauuucacccagauuauuggaaauauuauuucccuccugcuuaaaccgaagcugugaucauaauuuaagccuuucuagguagccgaucuuacauguaucauaccuauuucuggcauauguuugucuauuacaaagaccucguagguaugcaguuagaagccucuaguuaaaugaaauguugcgugugugaugaaccuggaguggggauggccuuuugugugccccaaggcuguuguguuucacacaguuguuuucugccuccucuggucuaucacuauccugccacugccagaaaacccugcuguguguuccccgcguggaggaucucugcuucugaacuucuuuggccugagaaacuccauaaccaaaucaguuagcauuuuguuuaaagagcagguaggcuguuagagcuugggucuuacaugucucccagguccacuugccagcgccuugaccacuguuaacuuuuguuaaccaacucaucuuuugcugccuguuuuuugggggguuuuuuugguuuuguuuaagccaagaucaguuauauggcccaggcugagccucucuucccagccucucaaauguuagaauuacaagcaugcaucccucagcauaccuuuccuuugcuuuuuuuaaaauagaguuuugccauagcaacagaaaucuaaccuaacuaagcauagccgugcacaugguaugaggaacucacauaugugugaauggaaguucauagagaccggcaucacugccuagaggccccuuucuuccuuccuugcaguugucgugcuagcugacuguacuacaaaagagguugucugaggcauaagacuaccuucaauaaaacaugcacagacaguuugcuucucugagauuucagagcagugacuaccuucaauaaaacauggacagacgguuugcuuaccugagacugcagagcaguuuccaaaaauuuuagacaaaggguaggaugaagaaggcugcgggguuuugcacacacuuaaggugcguaaguaaauaaacugagcuacacugacaggaugcucguucuaguagccaaccaaagagcaguugaaccaaagcaccuagacuucaaacaucguggggagauaaucuuaggagugcuaugcuucugcguccuacaaguauuaugaaacugucuagaaagcaccccacugguaaucccuuuuugauuauuuuuuuuauaaauucuagucuugggguuuugaguggcacacagacauaaugguuaggcuucggugugugcucauucacuuugcuuccuggggaccagaguuugcgaugagucauguuccaucugauuucugucggauccggcugcagagccaugacucagaugggcuucaggcccagcugcucaguucaucuucuggggaauagaugacaaggacgggacaaauguccugacgcacauuuccuucuguucuugcacuuccagggucuaacgagagcaucauuaccaacagcaggcagauacgccuugccacaggcaucuucccuguugucagccuccugaaccacuccugcaggcccaacaccaguguguccuucacuggcacugucgccaccguccgggcagcacagaggaucgcaaaaggacaggagauucugcacugcuauggugagccagccuuucuuuccacuacccugcugugccucacaccucacaugaaaaggauaaggggacaggaaucagcagauaugggcccagugccucuacucauccucugagucuuuccuggaaagggcaaugcauccuugggccaauaaaaaaggucuucuggcuguaauaaaaaagcccguugagggcagugagccauaucccuccaugccuuguagacagccuauccugaaaaugagcgaggagcacuuucuuggcuucuuucuuccugccccagcagcuuggaaacguauccacuuucacccguguuuuguuguuuuuucugagaugauagggcagaguacccaaccucauauaggcuaggcuagugucuaucacugagccaggaccccaacccagcaccaccaugccagucacgugaugacuaggccagccccucgguagaguaggcauugacucucuuggugugacuaggaacuguggguaaucucucuccagggccucacgagagccggaugggcguugcugagaggcagcagaggcugaguucucaguacuucuuugacugccgcuguggggccugucacgcugagacacugagagcagcugcagcucccagaugggaagccuucuguuguaagacuugcagagcgcucaugcagguaaaucucugcuguucccaggggcagggcuccagcuaaagguugucagucgccaggagaaccauuccugcuucccuucuuguaacuccucccuacaugucgcccgguccugcagaaaacacagguuguauuuccuaauauuuucccuauaagugacacaaaaucuuaaauuacacaaagggaccaaaaaaaaaaaaaaaaaaaaagcccuagaaauuuacuugcucaaauaagucaucaaaaguugugcaucaggccuagcacuuggguacugguaacccuagcacucaggaggcugaggaagaaggaucucaagucggaggccagucucaagugacaccccaucuaagagaucaccauuccaaggagcuauuucagagaugguuuaaucuggggacccagauuguggauuuucugucuguucaauuccaucucucugugcuggccucaucagacacacucuguaguaacugugggaaaauccgacccacauaguuuucccucagccuuugacccagagggaagagccacaguggagagcaugagagcagacccuugggugcuacugccagguaaugguguagacacuggagucuucaacauucaugccccaaugcaaaauggucuccacaccagagcauggcauucucauuagaaauaaguaaauggaauuggcuguguugaaaauuguaaagccaagggucaagaaugaagccuuccccagcauguuuuguuuuguuuuguguuuuaggcagcgucucucuguguagccuuggcuccugcccucugcuaccucucccaggugugccaccaugcugggccuaagcgcccugugcauuagugcucccucgauccugcucacucuugagacagucuuccuucuacucuguauccccagauaaccuagaguucacuucagagcccaggcuggccucaaacuugagauccucgugucccagcuucucaaaugcagugauauuuacaggccuauaccuggcuuucccugauagauuccuaguaagaugauuauccuuugagccauaucucucuucugcuucuuccucucuuccugcaggguugaucuagaauuuauucuaaagcugacuggccucagaauugccauccuacugccuuuaguuuccaagugccacuuuacugcaaugugucaccacauccagaguucuguguuuguuuauuugucuguuuuugagacaggguuucucuguguagcccuggcuguccuggaacucacucuguagaccaggcuacccucaaauucacugagaucugccugccucugccuccagagugcugcuguacacuaccaccacccauccagcuuucuauauugguuuuccuauggcguuuuaaaauagccauuauacguguguuuaucaucuaaaguccuggucccaaaaggagaugagaggggcugcuaaggugaaaaggauuacaaacgcuuaucaauucuguucaaaaauuaaaccucagagugggauuagcugcuucuuucauuagaauugcuaucagaauucacucaggccuuguuugcguguguuauugaagaagucucuuccucaucaggucagugacuccuuagcucaaguacaugcaauaugcaguauugauaacuguucucgcuuaggaauaaaaauagaacugacuuccacagggaaaugaugugcugagcuguagcaacgaaucuugcacaaacucugucagcagggaccagcuagucucucgccugcaggaccuucagcaacaggucugcauggcccagaagcuucuccgaaccgguaaaccaggugagauuggcucccucgcccuaggccucagcccuucccuuguuuauuuugguaucaccuugccuuacugagcaguccucaauaaaugacugaggacuugaauuuaauuaucccagcaccagccacaagauggcuauguaggccagugagaccagacugugaccagcuguuacucuggugcccuugaaagucuuccugaugguuuaagcugugucugcugcgccagauaguucuagcagcucgagcaccagaaaggcugucugacuuccaugggcuuuguguggcuccagagguccaaugccaucaucugauucccagcuuaaggaccuaagcuccgagaagguugcucugcccucagcagcagcagcaaguccugagugcugccugggcucguggugugacucaggaguagagcucgguagcuagccugagcugagagcugagagaaagaaaggacuccucucuuuucagaaagggauuugcagaacucgauguuagacccugacaugguaggaaucuguuuugacuauucuagccuagauucugaaguugaccuuuagccuagagucaagaaaacuaaugauuacaggaggaauguagaguugguuguuaaauguugguuggaaaauggauguuagaagcccaggguaaaugugaggaagccucaucuaacaccucuuuuacugaaagagaaaacauaagcaaccaacagcuucccuggaaugcccggcuguugacuccgugagauaaagaggcauuuucacuuugaccuaaccgauagagaccuugcaacguggucucucguguccaggacuagaucuguaucuguugugaggcauuuuuccuuugaauccauagagcaagccauucagcaguuguugcggugccgggaggcugcugagagcuucuugucagcagagcacaccguacugggggaaauugaagauggccuggcccaggcccaugcuaccuuagguaugcuaccuuagguauagccggaguucuccuucccugccguguguucagugcggcccuugccuugucuguuugguucucucuugccaucugaauugacgcucuucucccucccauucugcauuccuugcccccagagccuuaggcuaaugguguuucuuuuccggaaugagacauuucucuucucacagggaacuggcuaaagucugcugcccauguacagaagagucuccaggugguugaaacucgccaugggccauccaguguugaaauuggccaugagcucuucaaacuggcccaaguccuauucaauggguaggccuuucuuuuuccuaguguuuggccagggcacacagugcucuguguuuuccuaggugcuucuguguauggcuuuuugcuacagugcuuuaaagcauguugaaacucuuuuauuuccucuuuaggacagauauuugcccucugcuucacugauagacuuuaagcuuugaauuccuuccugaggauguggagaaagccauuaggucugcauggagcuucccagggaggauuuggaggcagccucacccgccucuagcauuccugucugcuuaaucacaccucccuuggcugccucagucccugcucucucaacuccagggcucggcccuuucccugguuugccucuuauuccuuuuaaagcagugguuuucaacuagaagggauugcaaauggcauuuggcaguguuuagagacaguuuugauuguuauggcugccagcaucuaguaaaggcuaaaccuacagugcacaggaccgccuccacaguggagagacccaaguuagcuaugugaaggcugagaaucccugcuuuggagauuaaaaaaggaagcugagggaaccacucaguuggaagcacccuugguggcaugcacaaggcccugguucugucccuagcucugcacaaaaaauagaauacaaggaagaguaacccuaaugagcuggucccucacccagugugccacugaggucacuugaagggaagucuagccccaauuuaguauuuuuuguggcugccauaccuccagccuugaucaaaucucaugguauacauugguaagaaaaaggguuugaaacauagaccugauacucggacauggaaacaguauguuuggucagagagagcgaaggaccugauagacgagggcaauaucagagagagggcaucagucggguuagacacgagcauuccacagugagcagcucuggauaagcuuuuauaaaugcugguuaagguuuugaauuugcccaauuuugucaggaucccagagucuaucacaaacauacacaguuuucucaaaucugcuuugcaguaugcccgugaaugucucuuaucuauacuuucagaugguaagacccugagggcagaggaacucagacccuuugugcccccuguaagacccugggggaugcaguggacccgacuuuguguucucugcacagaaaggaguccacuuucguugagacuaaggaagggaacugacaagcuucccuuucuggcuucagguuggcagugccugaagcucugagugccaucuggaaggcagaaaggauccuguuggugcacuguggcccugagagugaggagguccgggagcuccgggaaaugagguccugcuuacuggacucgucauucgucccuguggggcccuugguguagagcaaucauccucacccucaagaaggagcucuggugaugacugagauguucuguuggcuuggagcucucaucagagaggacgggaccuucccaccugaccugagccuagugucuggcacagagagcacuugaaaacagauugagacacucaccugccaugcuggcugcugcuugcaagagcuaacugcccucugauggaaaccccaugcccagaaaagacuaaauccaguaucuaaaggcugcuuuaaaggguugucacugcagccgggcuugguggcacacgccuuuaaucccagcacucgggaggcaggcggauuucugaguucaaggccagccuggucuacaaagugaguucuaggacagccagggcuacagagaaacccugucuugaaaaaccaaaaaaauaaaaaauaaaaauaaguaaaaaauaaauaaauaaauaaauaaaggguugucacugaucugcaggcagcucaugcuagccuaggcuuuuggcucgauuucaucucacuaaacgaugaaucuguuucccuggaacauuccuaugguuucuaguaguaaugaagugcuguguuccacuccagugagaacuucaauucuuagucuuguauuauaauugaaaaauaauauauagcaagaaaucaguaugacugcuuaccucaagagacauacaauuccacuuacaauauccugcuuccuuaaauuuuucauuaagacuggugauauauaauuugugaauggagaaauaaauacgucuuacuguuggcaguuucuuccugggauggc

SEQ ID NO: 12482 - RNA, 133406 nt, Mus musculus
ggaagugccaggcuagccgaguaaguagcggcucccucgagccccguaccuggaggcuugcucuucugggguccuggugacagacaggucgcgagcaggauuggagagggcgucgggggcugagcggcgggaugauggaggaggaggaacuggaguuuguggaggagcuggaggcugugcugcagcucacgccagaggugcaacucgccaucgagcaggugagcgcuccacccccucgggaggaagcugcgguggaaggggcagcucuaggccagggucgaaucuccccugcuaggcuggaaagguggcgguucuuaugcugagcggaagucuggauggugguaaagguggggauggguuuuucagccuggggaccgaacacgucuucucuaggcucuguguuuccgagguuguuacgcccugcugaguuugggccgagcuguccucuuugacaggauaaaccuagagggagccccgugacuagagaauucggauuaugguugauuuuaagacucuauucauuuuccagcuagugcggcuucuuccauuucucugguuaaacucuuggagugguuuggaauuggcagugggauacuuccauugcggaaacgaaugacagaauaggguuguggggcggcauacuggaaaaugacccuugugcuggugugcgcgugcgcgcgcacuugacacucgcuggagucaucugggaaaaggaagccucaguugagaauugcuuccaucagauuggcccacgggcaaucugugggggcauuuucuugguugaugcuguagaauggcccagcccacugugggagguaccaccccugggcagcagguucuggauuguauagaaaagcaagcugagcaagccauggaaagcaagccaguaaguaacauuccuucgugauuucugcuccauuuccuggcuuggcuucaccugaugacgacauacuauaaccuguaauccaaauaaauuauuuacuuuacaaguuguuuuuggucaugcuguguuaucacagcaauguaaagcaaacuaagacaaaucuguaccauaacuaaaagacugagggcuagugagauaguucaguggguaaaggcacugugccaccaagccugcugaccugagucucuuccccaggauccucaaaauagagggagaaaacuacuccuggacaaaacacacauacacaugcacacgucuccccaaccucuggucuacaaagugaguuccaggacagccagggauacacagagaaaccugucuugaaaaacaaaaaaauaaaguauuaaugguccauauaugcuaauuauuaguaguagaauuauuuuacuugggcuaccuucccaauagccauuaaaugagacacacucuuucuuuccuuucuuuuuuauuaguauuggagguugaacaaauccuuggcacaugagauaagugucuuaccacaaagcaauauccauagcuccuaaugugcuucuucuuacacuauaaccccaugucaguucccuuaaggaagaucuuucucccucuaucaacaaaaccuuacaaaaaccuacacaguuacuucuaauauuaugaccauacaucuuaauauaguugacaggagacuuuagucaacaaaaaacuucuuguugggaagagaagacucuuagggauauucuuuuuuuuuuuuuuuuaaagauuuauuuauuauauguaaguacacuguagcugucuucagacacuccagaagagggcgucagaucauguuacagaugguugugagccaccaugugguugcugggauuugaacuucggaccuucggaagagcagucgggugcucuuacccacugagccauuucaccagcccccagggauauucuuuagugucacccaaauugcaaaaauucucaacuuugggcuggagagauggcucagcgguuaagagcacugacugcucuuccagagguccugaguucaauucccagcaaccacaugguggcucacaaccaccuguaauguguaauguggucugaugccuucuucuggugugugugaagagaacuacaguguacucauauacauaaaacaaauaaaucuuuuuaaaaaauucucaaccuuuuaagauuuguacuguauuuuuguguaugugaccugugcaugaguccccuugaaaucccuuaaacugcccaugcaguacagugucuagacaucuuuugguaaaucuagaauuuuucugccaacacugaggccuggcauucucucuauaggugucaccggaugaaguagcuuaagucaagggcugcguugugugaaaucuguuaaugccugggauuagacccaggaacaggaagagaagaaugaagaaacugggagcaguuaggaagugaauaacccacuuccucauaccagcucacaaugacaggcccuguucccagcacucccucugcaaagggcuuuucauuaauucuauaauugcauguaugugucacuuguacgugugguguauucucaccuuaggugugcagcacagaagugcaaugcuaaacuuucaaaagaaacgacuaagcuccaccucucacugccuuugccucugcuugcccuccacauccuagaagcugugacucuucuaccuuuccuaggaagucauugguuuguccguguuuauucuuaaauaaaaaaaaaauuacuuauuuacuguuuauguguguauguuugggccugaaugaguuuaugugccccauguaaauucaggagcccuucaaggccagaagaugcagucgauucccugaaacuggauuuggaggcaguugcaaggaaccauauggguucuagaaacugaacccaagucuucuuguaagagcagccauugcuuuuaacccaucgcuccaacuccggauuuuuaacucuauauuccacagacugaagauuugcugaagauugcuuuacacgguuauuauuugucuuacgcuaguaaaaaucagaacccauaggaucacuuuucuuuaucuguuugguuugguuuuauuauuacauuuguauacuugugcaccagugugcuuauggagaucagaagauaaacugcagaguuaagucaauucauguggggccuagggacugaacucaggucaucaagcuuagaggaaauuacuuuaccugcugagucuaauuuugcuagucucuguugcacucuacuaccauauuuuggaagcagggucucauguaggccuugcccucacaauguaacuaagauugaccuugaauucuugauccuccacaaucacucuggaacacauguacacacacaccaccuccccagugcuaggauuauaggcauauaccgccaugcuccagcauuuuguagcccaccuuguuacacaguuuucaaauugugacuucugugaggacuugugugacuuuugugaguuauauuucucaagauaguuuucuuuuguuaacuugaauguuaguucuccauuuuuuuuuaauacuaucugaagcauaaagauuccuucaaggcaagccgaggcuguugcuuaagugguacaggauuaccuagccauagaugcggcacaggguuugagccccagcucuacauaaaauacacacacgcacacauacauacauacuguuuuuguacauagagguaaucaagcuuuucucuuguuuuucacaguguuuggauugaaccugaggccucuggguagacaucuuaccauugaguuguuucagcagcccagagaagggcaauauaagucaggcuugccucaggcuugcuauguagcugacaguaaugaccuugaaugccugauccucuugcuagacugacaggcuuugggauaccacaugugacuauagacagacauaccuaggaaaguuauggcuagguaaauguugcuucagugcaugugacugcugucauucaggcgccacagacaguagucugucgucaggcuucugaguccucucuuaguaggaggugcccacacugcagucucuacugugcugccguguuugcacuacaggugcugaaagguaagacugauguuaguaggugugucuuggaucccauccuaaaaucucucauauauaugcuggguuguuuuuuguuuuuguuuuuuuuuuuuuuccugucacaguuuuggacaccugaaaucuugaaucaaaaauauuaacaggagccaggcauucuggcauaccccuguaaucuaaguacuugggaggcugaggcaggagaacuagauugaggauagccugggcuauauaagugaguugcaaguuugucugagcuacauaguaagaucaucucuuaaaaaaaaaaaucagaaaacagugucugcaggcacacauucauucugaagacucucagguuggcuuucuucuugguugccaguguuguucaguuuccuugcuuugaaggugucguucccauccaaccucuguuuccuuauggcuuugcucucuuuguguccuugauuccuguaucucagcaucuaaccauuuucuugaguauccauuauaugugaaguguuauaaaaugaaaaaaaaaaguuggaauuuuucuguuuuuguuuuguuuuguauucaagagccugcucucuaauacuaagauugaauuuugaauccacauuuuuacaguuuuauuuccuucuucuaaguaucguucuuuguguguacaugacgugcugugcuagugcacaugccauagcauguauguggaagucagaagacaacauugugaaguuggauucugaggauccaacugggguugcuagguuuacaugacaagaugacucccccugagucaucuugcuggccccauuccuucuaauuggaacaacaacaaaaacaacaaacccaaacagauagacagacauuauauauauauuaucaaucuguggugucuaacaugauguuuuaaucaauaaccccuguuuuuauguagguauucccaagccaggauccucuugaucaagcugacuucaaugccguugaguauaucaauacucuguucccaacagagcaagugaguauacagcuuuagguuuccuucaucccgguaccucuggcuuauccugcaugucgugauuggugugauagacaaaugacauuaaguucaaaucaaaucccgcuguuucuuggaucccauccuaaaaucucucucauacaugcugguuuuuuuuuuuuuuuuuuuuuuuuuuuuuucugucacaguuuuggauaucugaaauccagaugucaacaggaucaguuagugaauggaacuagcaugguguucuuuggcaagcguauuaucagagauuguaucuugaguuugugagaguuucccucaguguacacagaacuuuguguuaguguuauagauugugguuucauagcauaggcaagaaaagcaggaacgagguagacaggauaaacuccaaguuacaaagcagcuuuuaaaauguaaagauguagcuagcauuuuguguauguucucuuuuugugugauuugcccagaugggguuuucuuucaguaauucagaguuagaagccagaaaauugggggaaggccagguaaauauauucuccuugcaccugcccccuacaggguccaauauagcucaucauagcuucacuguguagccagcaugagccucuuaccugugucuccucagugcuggcaugacaggugugugccaccaugcccaacuuggguuuucauuucuucacuaagcaaauguuuacuggguaccugccaugugcuaucacuguccuaggcacugggaugacaaaugugugccaccaugccugacuuugaguuuuucacuuauucacuaagcgaaugucagucacuguccugggcauggggaugcauccuuccacugagaugugcaugaucagcagaaggggugcuguugaaugcuaugagggagcuagggaaggaagagugcaggaaucagaccccaggagcuuucaggcaguucaugaagggcucguuuauuuagucagccaaugaaggucacuggucauuuaugaagcauauaguaaguauuagggacuguuuuagaaacuggaaagaaauggucaacauagcagguuagcuccuagucucauggagugcaggaggaagacaagaacuaaaaagugccucaggugccuacucugccuaguuugguacagcuggaagagagguugauucaaagauggaaguaagccaccaaauggucuuuacuaacacagaacuuacagucuacuuugauaauucagcauaggauugucuuugucaguagugaucauuguacuguacacaagcccuaacuccuaccacagcuacccuguuaagauuuagucuugaucugguauugauugcaccaggcauucuaaacauuugacagagauggguucuccauguguuauggaucaugagcagagugacaaguaaccaugacagaaugcucagcugaagugugacagggggcacauuggacauggugaaagcaaguuuaagaguccugagacucugcugaggaaauggcacgauaggccacaguaaggauguuaaacucugguuguagcuucucugcuugguagcuguuggcaccuuuacuugaugcugcaaggggaagaggaaugggguuagugguaagcaggaucaguggagggugugagcaguguaggcuguguuggcucccuugcauccauggaguggaaauaugcagauggauauccaagagugugguacccuccccaccacuguucauaucccaacaaacaccuucauacugagcuuuaccaacaggauccaucuuuuucugauuuuaacuaacaaagcuaucucuuuuugguuuaacagucuaauuuuuaaagauccauuaauuuaaaaaauaaaauuugaaaaauguuacauugugugauugucuuuuuggaaauccuuuuuuuuuuuuuuuuucaagacaggguuucucuguauagcucugccuauccuggaacucacucuguagaccaggcugcuggccucgaacucagaaauccgucugccucugccucucaagugcugggauuaaaggugugagccaccacugacugguggaaauucuuuaaguagggcucacuagugauagagauuugguaauaacuaacuuaaaggcauguuuagccauaugaguguuuuacuuuuccuaucucaacaugaguacuaguuugcuggacaugaugaagcacagcuuuaaccccagcacucaugaggcagaggcaaggagaucucugaguucaaggccagccuggucuacauaguaaguuuccaggcagccaaggcugcuuagcaagacccugucucaaaacaacaacaaaagcaaugucaauuuaacuaaacaaacaaacaaacaaacaaauuacuguuagaaaauuuguagaauuuuuccuaaccucuguuagaaagcuguaguuaggaagccagcagguuuucaccuuucugaaaugauuguaugugcaacacaaacaaacauacacauacacacaugcacacacacacacacacauuuuaaaggcaaagcauuuguuauccccuggcuucauuuuugugucuugucugauuaugccucuacaugcaugauaguaugcaaugaaguuucucccaguaagucagaaagcgcagaacagagugucaggucacacuugauuuuccuggacuuacaguuagaccuaguaggucauuaaccagcccaaauucccauggaccuucaaggaaaaacaguagaaagugauggccuaaucaucaauucuuuuaacuccuagacaaaaugcucaugcauacauagcauaggccuauaaaagauacuuaauuuucaauugagaucauuucagagauguuuguauaugaaggguuaguggccuuguaacugaggugaugaggcuguauuuccccuaaguggcgugcauguuugugggugcuguggcugaagugggggacacaaguccucagauggcucuccuucaccaaguuuaaguaugagagcuuucuguacaugacaguguccccuacguggugcuggagaggagccauauguguuaacaauaaucuggaaaacauuuucagcuuccuuacagugaaucuuuaaaaagucgguuuucauguuauuggaaguuuaagaggagaugcuaugaaauuuauaaaaaccaccagcacuugaggauugccugagucugggaauuaaaaaccagccuggguaaccuagcaagacuccuagcucaagagaaaaaacaggcuguagauaguguuagaguauuugucuagcauuuguuaggcuagaggcuccauuucuaauucuggaaagaagaaaagggggaaaagaaaagaauaguauaaucaagaaauuugagcuuagcugagcacagugucaucuguaaucccaggacuuugcagcaagaggaucaggagcucagaucuagcuacuggauacugagagaguauaaaacuagugugaccuacuugagacacucaaaauaacccaaaccaggugcuggagagauggcuccgugguuuuaacacuuguggcucucacugaggacccaaguucaauuucuagcagccugcuacccccaaccauuuguaaugccaacuccaugaguccaguguccuuuuacguuuuuuucaggcaucaggcacacauauggugcacauucaugcuuacaggcacucacacagcaaauaaauacaauuaaaaaaaauaaguaaacaaacuuuuugauuuguugacuguuguauacaccuauaacucaacugcaggaggaccaugaauuuaaggccagccuugucugauggccagccuugucaaagacauuuuuaaaaaauaauuauaauuuuuuuuuuuuuuacugaucuucaaggugcucugggucuuuauuaucaaguagaaagaaaacaaagaaagcaaacaaacuugguuuuuuugcuuuugcaggugacaaaugaccucaaucuguucuuaagaacacaucuauuuccauagaagaauagaguguaacacucacaacacguacacuuucuugagaacaugggauuauuuuaccaaggaucugaauuuucucuguucggcaugaauuauucaaaagaaggaaaugauuuucaauaaagcauuuagcaguacaauccuauuacaaccaaaccagaugagugguugucaaagagaugugccaagcagcaguauguccauaugcuggauucccacagggcuuucuucccacuccugggaagacucguaccucauaggcugcacugaacagauggugugugucagcucuaucagacgcagguguaaaggaaggucaaccaucacagagagcaugggguguugcucggugauagaaugcuggccuagcagaaaccaggcacgagcacuucaaaacaaccuaaaagaugaaggggaaaaaagcaacuagaaucagacagaucuccagaacccuagacuguccuuucagacauuuaaauuauuuuuuauaaaauauuuuauaaaaaauccugucugauuccugaauuuuaaccuggaaggaguaugguaguguuccucguguggcccaggggauuaaggaaaauaauuucugugaggugaccaaauuaauugauaacacccucucacuuguguuuguucaauagguaagcuguacaucuaucauguaauuaaguguaggguguguguaugugugagugugugugugagugugugagugugugugaucuggggcuuuacaugugcgaggcaagugcucucccacugaucucauguccugaguugaaacuucuuucuguucuuuugauaaccuuauuuguguacugccaugccuuuguucuuuccuaaccugccugcccagugucucuagggguggccagaagggccaucagaugaaucugcccuugugcccuaauccuuuuuuuucccaaucaguggcccuuguuuacaggucuuugucauuuuaaauauucaugugugcaggcauguuuguaccgcuguguguucuuggaggucagagaacagcuuuuggaguugguucuuuucaucuacuauaguuucuaaaacucagagucaucagguuggcacagcaagaucuuuuaccugcagagccauuucacuagcccucuuugauuuuuaaaaugcaguuccacaucugcauaauuauuuuucgggauucuuagaaagcaauguuguaugaagaagaagaggaggaggagaaugagagagagagagagagagagagagagagagagagagaauaauguaguuuaaccaagaccuuccugucuaaagguaauucauuucuugaauuagcaaauuaucaaaugucuacuguagugcagucaguauugaucaguauugauugauugguguggaauggccucccaggcauauggcuaagugaaauggccuggugcagcugauccuuggaugugcuuuuaacucagacugucugagaaaguaagccagaagcuggcucggagccauggcuucugcucaagagaagcugcagucagguggaacugggcaagcggaagccugcauuucacuacgugcucuuacugucuagauuuuugcuugugaauauguuuugacaauuuuaaauaccuuauaaauauuuuauacuuguaauuaaaacagucuuauaguguguaauuauauaugauauauacauaguuauccaugaguauguaagacauauuaucuuguaugucccucauuuagaggugugguaacaaagcagaauuccuggcugccuucauccagauuucucaaauacuuuguuuuucuuuugagacagggugucucuguguagcccuggcuguccuggaacucgcucuguagaccaggcuggccucgaauuuagagaucugcuuggcucugcuuucugaggagugcugggauaaugaugugugccacuaccaucuggucuuaaaacauuuuuuaagucaacgugugugugugugugugugugugugugugagagagagagagagagagagagagagagaaacagacagagacacagacagagagaaagacaaaggggaggagagagagggagggggacagagagagacagacagacagacagacaaugacuauauacacagacugguagaaggcucaacagguaaggcacgugccccuaagccugaggaccuaugugaggacuuauguucagucccaggacucacacaacagaagagacccgacccucacaagcuguccuuugagauuugugcucaagccgugguacuugugugcacauaccugcacuuaagugcacacgugcgcgcgcgcgcgcgcacacacacacacacacacacacacacacacacacacacacacucucacuacuguugcuuuaagagggcuccaagccgggcgugguggugcacgccuuuaaucccggcacucaggaggcagaggcaggcggauuucugaguucgaggccagccuggucuacaaagugagucaggacaggacagccagggcuacacagagaaacccugucucgaaaaaagcaaaacaaaacaaaacaaaacaaaaaaagagggcuccagcagaguuaguaggccaggagcuguuaugcucauuuuccuuagaaacucagggauguugaacaacugcccuccagcgaguuggcaguggcagaguggacgagugugugguccuggauaacucacuggcuguucugacaugggcagugauuuaaaucauacacaguccaguugugaagggacuaacauaacagaguaggaacaaguucaccccaccugaguuguuuuccucauuaaaauagcuucucuuuucugaauuucacuuucaccgcuggcugacuauucuuggauuucugaaaauuccgaguaagccuuggcuuagcggaaguugugugaacaggguaauguggcaucucaggucuguuccuggaagguuucuggcuuccuccuguagcagagagccagaagcaauuuuuaauuuuuaagcguaguuccuccugagaaaaaguaucuguuggggaaaaggccaagggaauuagaaaauuaccauccucccaucuuccaccagggggcaccauuucaccguauuuucuuucgagguuugcuuguuuucacuauuccauagcagucaguagagaugaauuaaaauauagacaaauacucagccaccacugccugauuuuuuuuuuuuuaaagagacucacuaaguagacugcuacucaaacuugugauccuccugccucagacuccugagugcuggcauuacagguguguaccauugugcuugcuugagcagacucaugaacuuucccaggugaagggcaccaucacucaaggaggacccugaggacuaacacaguguccucggugagccucucuggcugugucagccacugcuuccucagagagcugcuguuggacucgggugagaaguagcccccccccugcuuugggauugcaucagugggguugugucaucugcagccuugcuccugacuuuccccagcagugguguguaagaauuaggcaucuugguauggcuguauccauucaucccaugucuuucuauaguuuguuuuauagucauauuuuuuuuucuuucgaggcagggucucacuuuguagugcuggccagccuagaacucaagagacuccccuggcucugucuccugagugcuggaaauacaagcuugcaccaucucauccaggccacaaccuuguauguccuguguuagcaaacuucccauaaaggucaagacagucuucuaagcuuuauaggucccgcagugcccgguacagcuucccagcucugccaccacaguacaugagcagccacagccacaugggaguugacuaauguggcugccuuccaauaaagcuucaaaaagagaacagauaguauuugucagcuaugcuuaggggcugggaagauggcucaguacgcacugcugagggugaaaaaguguggcgacugagucugguuccugagcacacauguagaugcugggcaugguggcuugccuauacucucagcacucagaaggugaagacaagggguuuccagagcaagcuggcagggaagacuagguggaucggugagccuugggugugagagacacuaccucaguacauaaggugggcagugaggaagacuccugaugucacccucuggccugugcaucuguguguucaaagaauggacauacaugccuacacacauguacaccaugugcacauguacacaaaccaaaacauuuuaaaaaaauaagaugauuuuuaaaagaauuaaaugugcuaucaagaucaaacuucuugaggugucacaaacaucccuugagugcauuauuucucugugaaagaaaauuccaacaaggacauuaacagccagcaaucuucuuuucuuuauuguagucucuggcaaacauugacgauguugugaacaaaauuagacugaaaauaagguaaguaaugccauaugcuuuuuuaaugaaaggcauauuguuaaucuagucauaucugaaucacauuuuuugaugaaagcacugaaaucucaaauuuaaaaguaauucuucucuuguggcuuuucauguaaacucuauggcaaagagcuugauucuuuggccaguguuuuacugcccauacaaaacgaagggagcuggaacagacuguucaaaagcaguuaccaucaggcgggcugucguggugcacaccguuaaucccagcacucagggguagacacaaguggaucucugaguucagaaccagccuauuuuauauagccagggcuguacagugagacccugucuuaaaacaaaacaagaccaaaaaaaaaaaaaucaucagggcugggaauguaacuuagaagagugcuaacccagcauaauaacaugaagccccagauucaguccuaaaagcauggcauaaacccauaaaccacguaugggugcaaacacuuauagucuuagcacgugggagggagaggcaggagaggcaggagaggcaggagaaucagaaguucaaggucaucuuuggcuacgugguaagcuugagaccugucugggauuuaugagaccuuaucaaaaaaaaaaaaaaaaaaaaaaaaaggaaaaaaggagaaagaagaaaaguuaacuuucaaagaaggaauaacuuuucuauaacguuuaaugcuuuuauucuuuaauagguuugccuauuuuguaguacuaagaccagcuauggagaugagguuauaucuuuuggucaccuguaacuauaauauugaaucugcagguugacuuagguguggcccagaauuaaacuuuaugguuaacccagagccucacuguccaugucaucauuaggugcuuccugcccaguggucuucuucugccuuauccacgucugcauuuauacauuugguaccugagagguacuaaacaaacgucuuuucauuauauaaguagcuugacuacguugcuccaaauuaauuuggggaguuuguauguacucauuuguuuccuuuuaaaaauauuuauuuuauagauggggucucucucucucucucucucucucucucucucucccucucuuucucucucucucucucuauagucccuggcugucuuggaacucacuauguagaccaggcugacuucaaacucagagauccacuugccucugccuucaaagugauaguauuugaauguguguaccaccauauccagcuugguuuuauuugacuuuuuuuugaugagaagacauuuuaaaaauugaaaauguucauuuugagucuagaagaugaguuguuccccucccccaccaaguucuuuagaucuuuugguaaagggcacugccauaaaugugucguccacuguugccuuaggaagcacaaagaggagcuagagaggaggcuuguuuauuaaagcacuugucgcucuuaacacgaagaccugggcuuggcuaccagcucccacacaguggcucacaaccaucuauaacuacuccugggugauuugacacucucugcugaccucugcaggcacuaggcauacauaugguacacaugcauacauacaggcaaagcauucauacacauaaaauaauaaaauaaguacaucuuuuuuaaaagagccuccuuguuguuuuguuagcuccagccauaguggcucuagaggagaccugagcauggccagaguuuauauauagaaaguagaacauccugguaacccagggagcccuggcagcaagguauuuccugcauucuugcuaccauaccuuaaacagauucuucagguacaagaugaagcugacugacagaaauaccucuggcagaugcccuguacaauggcccuugcugagcccaagggaaaagagauccuggaagccauagaccugccucugacaacaucagggcacaaagaguaagcucugauuucacaaaucacacuacuccuugacccuuuuaaugucuccaaaguagagauuuugcaguugcuaauuugaaucugcuagcuucuuucuguaaaacaccuuuaauuuugucacugcugguuuacucuggaaacauuuacagucauauugguucuuucagccacuucugaauauuagcucuugccccuuuuuaaacaagauaaugccuaugccugcauuaauggcagcuucuuguguuuguauugcugcuuguacuuguuugggacucugcacuaaauagacgcagccuggaaaggucggugagugaaugcugauuuucuccccagaauaguguuuacuugaaugacuuguaucuuaccucugauuuuuauucuuuuggccaggagacuggaugacaauauccggacugucguaagaggucagacaaauguggggcaggauggaaggcaaguaagugacacaucccucugcguugguuucaguccccuaauuuuauaaagaccaaaaaaccaagugaccaaaaguugagcaguuuguuugcaguuuauuagucuguuccuauacagcaggaagcaugguugaccugccccaccaugucaggggcuaaagaccagccacggacucucacucagugcccuccagauccgcaucacucacguauuaaugcacagcucacccagggccagcaaccugcaggcucugcuggaugaacugaaggguccugguauucauccuucuauguccugugccggcuuuggucugcagccugguugccgggcacaguuagauugcugugggagaugcugaggugaggcagccaugguuccucaccugcucugccagccagcaggacugggcucguucuagugugccagucucacuuuggagggcugugguggggggagaaggggaaagaagccuauggagaggaggucucuucgguaacugaagggcgaauggugucuguuagguaacucguuucucguguauuuggauucuguucugagauagcugcgauaacaggugcugagugugccuuuuucucuuuccucuccgcaccgucuagcccucccuuucaguuaguaauccucggccagccaugcucuacugggaugcccccuccucccuuguucuguuuggcuuuucugcagugcuggggaucaguuccagggccuugugcacaccagacaaguguuccaccgagcacuaggugguuuugagacaguguugacuguauagcccaguccucccacuucagccugccaguugcugggauuacacaugcaacccacuguggccaguucucucuagcuucagaaaacacucaaugcugcuuagcuuuagaguguaaaaaaggcucucauccuagguagaggucuccucaucugcagcaccccuguuuugcugcuaauggcucaaagaugucucgacucuuacguuaaguuuuucaguuuuauauuuacuguucuugcuuuuuauuuauuuguguuuauuuguauuugucuuuauuuuauguguaugaguguuuugccugcauguauguggaucacauuuguaccuaaugcauauguggaggccagaagaggauaucaauuagaauuccaagaugguugugagccaccauaugagugcugggaacugaacuugggcccucuacaagaacauugagugcuccuaaccauugagccaucucuccagacaucuuauuuauguuuuuaucguguguguguguguguguguguguguguguguguguaugugugugugugugucuugcuucuacccuauauuugugacagaauugucuacugacccuugagcucaucaauuugacuaaauuagcaagcagucccccaaagauccuucuguuucugccucccuguugcugagaaggcaggcguguauugcuguaugaggcuuuuuguggguguugggauugaacucaggucuuuguacuugagaaccaccuaucuuagcgauugggcuauugcccuagauucauuuuuaguuuuauccauuucugcuuccuacauuuauggcuuucauucuguucacucauaauauaccccuucuguugguauccaugguacacagccuaucucuguccuuuuucuuuuuuucuuucuuuuuaaaaaagugauguauuuauuuucacuucauguacauugguguuuugugugcauggauaucugugugaggguguuggaucuccuguaacugaaguuacagacaguugugagcugccauguggguucugggaauugaacccagguccuuuggaagagcagccaagugcucuuaaccacugagccaucucuccggccccuaaccuuuuucuuaucaugaguauuuguugcuguuagcucucuaaagguauccuguuucccgaccucucacagguuuacuacuucgucuuugucuaccuggucccauguuaacaggaccuuaggagugauaaucaguaggaaggucucauugugcugauuaacuccacuucuugugucaugccauuugccucuucagaacacucugugccuccugacacugagugaagucaaacacauuuucuuaccugcugcuugaggcugccuucaguguuuucauacucugucucuucguuuguacugaaaacuuucugcucugucacaugccacgugcucucugacccaugcauaucuuuguaccuguguuaauuauuuauuaucucugugacaaagcacccaacaagaagcaaauuaagggaagaagggcuuauucuggcuuacaguuggcgaggagacaucugucaugacccagaaggcacggcggcaggagcauuaggcagcuggucacauugcauccgcagucaggaggcagggagagguaaaggcugcuauucacuucaguuucuucuuuuuagucagacuaggaccccagccuguguaguuuagggagggucuuccugcuuucuuauccugaucuagacagcucuggauaauccugcucacauuugccucuuaucgggucacccaucagucuucucuguuaaggccugagugcuuuuguuuuuguuuuguugggguuuuugcuucccuuuuuuccaguuuucacauuuuaaagcuuuacccauuuaaaggccagcucaaauacugcuuuuuaaauaaugaaguuuuauuuuucccaucugaauaacaccaaaggaaucauaauuucagguccaaggagacuugaccuuuaucugacucuagucuucuacagaggggagacagaugugugcccuuccuaccugucacuucucagcccucugcugugccaggccuccgagcucaugcucuuccuuggcuugccuauccucuuggcuaguuuguagacuucuugaaggcaagaacucuuuuauuaucuuuacacuucagcucaaauaguccuacaugcaacuacacugaauauuuggugugucuuagauuagcuuggggcuuccugaauucuaggcaaguguguguagcucuauggcugagcuacaucuccagccuaugguucaugugugaauaggcccaggcugcugcuauuuggaauagaacuacuguauugugugaccuacauuuagaauggcucaccaggaaccuuaaacuacuugggagagucucagguaugugaaauucuaagaaaaugaaaagaaguugaugauucuugaggaguguuuguuggucgugcuguguuggagcacauccuggccacuaccugugggccaugcuagagcagcaugggggagugagccccagaaagggcaggccucaggaaugccucuccccaccuucacgugguugccagcagggcagcucggauuucagagaacaagaccguguuuucaagaauguuuagaucacauuucagucugugauggaauuuuguauucaucuccuuagaauccagacagagaggaagcccagaagaaauaaucgcuuuuccugucaucuccuccaucugucucuccagcagauugaaaugcaagcucgaguggggacuuucagcagagcaugcuugguucugucuuugucagcuccuagggauagaacugugacucugguggguggcuugcugaugggcaucuccagcugacuggcacagacgaggggaauuacggaugggccaaaauacugggcuucacaggucaggacacccgugugccccucuucccuggagcacacucagagauugcuuucagaacuuaucuucucaguggcugagaacacucaggacagcagcaguagggccaaaggaaggugcccugcccagacagaauuucccaagcccaccagagcagcugugcuuuuuaaccuugaaaagcaagagaccgaccuuagugcauaucauggagucuuauuugaauuugcuugcuuuuuuguuguuuuuggguuuuuuguuuugguuuuuuugagacagggucucaugaaguauauuuuggccuuaugacccucagacuuccaccucccaagugcuaggguuacaggugcaugccuccagaccugacuuuuaugaucucuugaaagacauuuuuaagacauuuacuauggggggagagucauaagcgugugcaucagugcauggacugggaucagagaacaaguuggcagagucaguucugucuccuuuucuaugguucaggacugaagcccagcuuguuagaaccucaugcugcucagccaucucuuggccuuguaaauuacauuuuuaggagggaaguucuuuuguguucucugucugucugucugucugucugugucugucugugucugugucugugucugugucugugucuguguguaggcaggagaucagugucucuccaccuuacuuuuuaaagcagggucucucacugaaccugaagcucacugagcuaggcuggcuaaacagcaaucccuugagagcuacucuccagcacugagauuauagguguaugcugcugcucccauauuuucuggggugcuagagaucaaacucaggcccucaugcuccuucacugagcacuuugccugaacccugaaaaaaguuuuuuuuuuuuuuuuaauuguuuggaagugagcaugguggcacauuccguuagucccagcacucaggaaauagaggcaggaggaucucugugaguccaaggccagcuuggucuacagauagagcucugggccaguuagcuauauaaugaaaccuugucuuaaaauuuuuguuugugggauggagagaugauccugugguuaggaguccuuguugcucuuccagaagacccaagguuccugguacucauguuggacagcucacaaucaccuauaacuccagcuuuggcagaucugaugccucugaccuuuguggacgccacacuccugaguacaaacuuguacccagacacguacauauacacauaaauaaauauuuaaaaaauauuugggcagauuuuaaauggaagauucaaugaggcuguuuuucaguuucuagaauacuagcugcuugguuagcaaucagcuaaauaaacauuuuggaaagccuuugcuuguugacugucccuugugugggccagcaugaaguggucuagucugugacuucuucuaaccagacuacaaugcucuuacaaaauuccuguggcaccaaguccuccccauuuucaucuguugagaucaucaguccacaacucuaguuaaauguucacauguugaaaauguguggauagugagucaguucagcaaauacaugcucugcuaugcucuaaaauguaugccgcuucccaagaguuaaagcagggagcuagaagguagcuagaaagaggugaguggaagagcagguucaaggagggaaaagcugggauugaaguugcaagagugccgccacagcaugaccaguucccagggagcuugcugcgaaucacggaugcaggaguggcuuccggcuuugucucuugugugcagcuuggccagagcauggcuguuucuuugaacagagccugacugagguuuaggaagggaagagaacaaucaccacccucuccagcccccugcuuacugaagcccagguuuagacuacuguggugugagccuugaccccauggaaaugacuuuauacggcuucucugaugguuugugauucugcagaagcauggaaauguauaugaucacaacuguacuggcccauagaguagacuuuucagauguguucagcuuuaauugcgagaauucucuuagacugaacugaguagggaaguagcuucacuacagcucucaucagucucaguucugccagguggaucauguacaccuagccccauucccugugauagucucugccauuuagaauggcugugggguuccuuuucugacauaaccacccugcauuuccuuaauucucugaugcuauuuccagagcuuucccuguucugaauggcauuugucagcauucccuuaaugugagauccucgggaguagacacuauauaaacacacagggggugcucuauuuccuuuuuugagacuggggccacgugaagauuccuucucuggggagacacagaucaaucuauccuuuccucacaaggucccaacaacaaaccaaguacaguuucaccagaauucacccuggggaacaaaugaguuuauugaauuuacuugcaguguaugggcuagagguuauuggcaggaguuuggguggccccaaagaagacuugaaagucuucacccaacaugacugauagcuuccccauagcaacacacaugaaguuccacuuuaauuaaccgucaccaaccuguauucucuaacuccucccaagauccucaaggcccgugcaguuauggcagaauugcaggcagaugacugggaagaccaacugguuucucagaugagaguccaguaaccuucccaugcccuccuucucugagggaaugccauccuucaacaaaccaaaugguuaaugaugggcucucgaaagcauccacaccugaccugaugaagauacaggauguuucauugagauaacugcuuucuguuauagaccauucaggaucuaucaacacccugagauuaacuacauuuuuauguggauagacaucuucugaagggaagauagugauugcuuuucuagagucucuggggagucugcagcuucagaaguuaaguggcagugcuggagcuccugcucuccugcuccccagggucuaguggggguucagcagccaugucacuucuuggccuccacagauugccaguccccugcaguccucaggucaagagcugcaaggauagccuugcaggugagaaagcaauggaagcagcuuaggcuguugagugugugauccaugucugucuccuuugggacagcgaaugaagggucuuaaggagacaguuguagcccaguugucagguccgaauguagaccuggaguugccagauccaucucuguuucaagagaagccaggauuguggguuuuucugugccuccccagcucuguuaguuggccugguguuuuuccuaaacacuguaaaggccaaacaaaacauguguggcccagcacucuaccacugccccaggucuuuuucaucugaaccucauuuaaacucucuccucuauuugugugguagauucuuuaaaaucugcaccagacuuuguaugugcuacccuugguuauaucuuuguuuuacuugauuguuugaaccuguccagcucgcuguaaucucagugacuucaccaucaaaucugccacauaugcccucucuguccacucaagguguugaugagaaaguggaacaggcuagcucgagaacccuguacucuaccaucagacuccuccugcccccuucuucaucuucacuucagucuaaagugccaggcccagaaaacacaaaauucuuaccuguucaucaucauccaggguacucgugcgcucgcucucucucucucucucucucucucucucucucucucucucucuguguuuguuugcuuguuucuuuuuuuaagauuuauuuuuauuuauguguaaauguguguguaauacauguguggguuaucauggaauuacaagcaguagugaggugcuugaugugggugcguggaaaccaaacucauguccucuggaagccagcaagugcucuugacuacugacccaucucuccagcacccccccccccccagacaauaucucauauaguggaccaggcuaugcuagaacucaauagguaggucaagcuggucuugaaguaaugauccucuuacuucugccucuugaaugcuaggaugacagguaaggcaauaccuugccuggcucagggccauguuuacuaaucauuggguuucuguuuucucuagagaaggagguuaacaauacuuaguugcuucacuuguaauagagacaucaugaagauucaggagccaaaucaggaaaguguguugcuuuccaaggagaaauuagccauugcuuuucaucauuaaaaauuagcaccucaucuaauucaagcauuagaacagaaauaauguucccaagacugaaguaggucaguguuaggaggaacacacgcugcgcuccuugguguagcuaagugugcucucagcaggggaauggcgggaguguguguuccaccuucaucauuguuaguguauagcaccuuccuugggaaaaguuaagcccaucgacugaugaaauucauuaggaaauaaaugauaguagguuuaaagaauacacacacacacacacacacacacacacacacacacacacacacaaauugccagugcacaucuguaaucucagcacuugggaggcugaggcaagaagaucaugaguuugaggccagccugugcuacauucugaggaccagucuguaauaaauaaguaaauacauggaugaaugaaugaaugaaugaaugaaugaauaacaacugcuucuugauuucuccuucuaaauuuaccaccuuaaaaugaguaagcuuuuugaaguauaaguuauuauuuuccccuuaguaaguaauugauaacagcugaacauuccugccucagccucucuaguagcugaaacuacaggagcaaaucacagcaccugcccccacaauccauccuccaccaucuggggugugucugcacaucuguguuuuucagucuuucugucuugugucucuuuuauauuuuacuuuucagaauauuuuuaggcugaaauagcuguggucugagcacgucccaggaaugcagacagcacucacugauucauggaacagccuggcugucagccuucuguaagcauagugucccucaguguuugagccuggcucccauucccuacccaggacuucuuacaccuggugcagaggcuaaggguggcuugucuuuaucugguaaguuggguccguguaaguguucuucuuugcuugcuucuagagcacuuaacuguggcuaaagcaagagcuuuugaugguucagcccuguaugugacuggguuugaucugacuacuaaaguacaugcuuucauugcaccugagcccugauagcaccuuggcucccauaugguguuugagacaagagucuuuuuaaguagcccaggcuggcuucaagcucaggauauagcccaggcuggcuucggucucaguacuccugcccauccugucacauguagugccuuuuuauuuuuucucgugaacauuucugaggccuccuauaaaacccucauguuuaggcagacuaugagaaaucuaaacagcuguuuucucucccucuaugacuaagaaaggcugaacauuuuguugcaguucucagaguuacuuacagucauugggccguguugucuguugguguggcggcaugguccaauugaaaaugcuugaguuggccuugaauuugaaagucaccuccucuguuaucuguggcuuuaggaugugauaccucuuucagcucaagauucauacucccucugcugcucuuuuaucucuuaaaacaggguuugucuguguagcccuggcuguccuggaacuugcucuguagaccaggcuggccuugacucagagaucugccugccuuuaacccugccuccugagugcuggguuaaaggugucuguaccacacuuagccuuugccccaggcucucaucuaagucaugaagauaaugccgaccucaggguggugaggucagaaugaauguauuuucaacaucccucacacugcuaggcucacucaagucugagaaggggcuguaauguugcagguguggcuacugauggugacagcccuugggauacuuguguccagaugucuguuggguuccuuugucuuuuccaccagcucugaucuuuucaguucucacugcccugcuuuaaagccacuccagguaccugcauguccuucuggagcucugagccacacccucagcccacacguccugcuucgugagcuaauuuucauacaugucacuuauucagaauucuuugacucugaugucuaguucuuucuccugcugucucaguuucuauucucuuuccaugauuagcguugccuuuccugucugguccccuacauuaaacuagauuagccagcauggacuuuucaaaugacuaucauuucuaccuuuuccuguuuucauucauuacuuuuuacucauguguucaucauguguauuacuuuuucuuucuuuuuuucuuuuuuuugagacaggaucucucuauaucgguuggcugccugucuguacuggaacucacuauguagagcaggcuggccugaaacucacagagaucugucugccacugcuuccugagugcugggauuaaaggcgugcagugcuacacuuggcucauguauauaacuuccucuuucuucucugucuuauuugaacuucuuugaaaagguuguguguaugucuguuagaggaagggagagagggagagugggagggaggagagggagggagagagagaauauguacauauauauaugugugaaugugguauacaccugcaugugugccagcacaugcaccuuugcacaggcauauggaggccagaggaggcuguccugugucuucuaucacucuccacuuuauuugagacaaggucccuuacugaaccuagagcaagguugcugucaagcaaaccuagugauccuccuguccugcccccacaguaugagguuacaggcacaugugugauuaugccuggcauuuuacauggugcugggaucugaacucaagcccuccugccaguuuaauaaaugcucuuaaccacuaagccagcucucugucaccugagaguaaugguauuaagaggaaggcuuuuuuucugaauaccacauuggccacaucuuuaaaguuuucuaaaguaguggcugcacuugugcugacuaacagauaagguuccggguuuuagaauauauguguguaacugaguuuaugugucuaugccaugugugcaggagcccucagcggucagaagaggacacuggauccccuagaacuagaguuauagacagugggugccaagaaccaaaucuggguccucugcaggaauagagagcaauaugggcucagcuuaaccacugagccauuuuuguuuuauaauuucaccugagaauagagcuaaguguuacggaauauguguaaugauccucuuuaauuuuuuuuuuuuuuuugcuaaaauuaguuaauauggcauauagaggcaggcuuggugggggggggguggcacaugccugugaccccagcacuucugaggcugaagaaguaaaaucuugaguucaaggccucugggcuacauggcacagcccuguuccagaaauaaaacagagacauaacuuuugcuucuucauucacaucacuacacuuaaaaaccauuuuguauccacuaaugcaugucuguaugugugguauguguuuguaagugcaggcuucauacagaagucagagacaacuuuguagaguuuacuuucuccauccaccuuuacguggguuugggaaauccagcuuagguugucagaauugugugcgaagcacuuuugucuucuugccagccccguauccuuucauucuagacaguuuuaucgagauagaauguacauacaaugcaauuuaucuguuuaaacuaucuuuuuauacuauucaguaucuuuugauauaguagauugcuaauauugaaaaauacauaggcuguauguaacauaauguacugugguguuaauuguggucacagugcugugcguguguuacugcucucugaaccccaugcaucccuagcagcaauucuaaucauuaagcagaagcuccuauagccuccaauagccuuucccuguggguuuuccuuuucuaauaugccaaauaaauggaguccaacaauaucuauacuuucauuucugaucuauuuuacuuauaucugcuacguucaucuauauuaauguuguguaccagaacuuuaucaccuuuauugcuagguaauaguaccuuguguggacucaccacauuuuggguuuccuuccaucugcucaggguccuucuuuccguuuuuuucaguaaauacuugagaguagagcuacuggauaauuuaucuuaauauuuaaucuccuuagagacaauuuccacauuguucaaaauguuaguguuuuucuuuuuuggcuaaacucagugcauuaauauaagcaugcuuccuauuuugccuucacuuaauacgugagacucuauguuucagauaagccauacacaggcuuaagcuuucaauaacaagagacguacuccccauaccagcaaaaaccacccugcauuugucuuugguuuaguuaacaaguccagccaucaggcguuuccuuccugaccauagaaacacaauucccacuugucugcaacaugauuauugaaaauacuuuuagaaaaccagugugccaagugggaacagagaaguuuuauucuucuucugagucaugcccacauaaauuggcccagcauaacgguugcuaccucuccauuuccacguugaaagcacucaguuaagagcugaaacuggagucugcaccugaagaggagggugucacucaucaccauuguaacuguuacucuugcuuugacugcuagcaacuagagacuuugaaaggaaaauuccacuuucagauuaaggcuuugccuucggaaaaaaaaauggcaauaauucuaccuaacgacaggcagagcuuuccugggucucagguuuugacacaggaagucauucagcuguguuaaaacaaugggugggaaucugaaacccugucuucacauacaaaccuggccucaguuuuucuucccucuuuaagccacagaauuuagagcaauaugggcucagcuguguuuguucaucaguguuuucauuaauaauggccaauuuucaggggucuguaauaaagcuguaaaauuuccuuugcucugacuuggacacccuggucucuucaaggggagauuuaauuuuguaaauccauagacaaugcuuucuagucuguauuggucugguguuuuacaguugucuuuauuaaagcuuuuaaacaacaagaaacuuguuagccucucaguaguguuggaucacaugccaggauuccaauuuuuuuuuuuucauuuacuuuugaggcaggguuucauguaccugaggcuggccucaaacuuucuguguagcugaggaugaccuugaauccggagcccccugccuccaccagcugcuaggccggauucugauuucuuuuucccuguuguauuguggacucuggaaagacucuggguugcuuuugguauaugauucugauucacagacuguggguauuggccaguauaguugagugccuaugguuaaaagggagacauuucuucuauaauaugucuacuaacaagauuugaugaucccaauuuuguuuuguuuguuuuguuauauaaagcagaagagcauaaagaaggagaggugucucaguggguaagaguacuugcucuguaggagugaggaccugaguucaaaucuucagcacugauauguaaaguccugugugaucaugugauuauuguaacccuagugcuugcuugcuguagugcaacggagagcgauagagaagacggcccaauguccuccucugauguacacucauaugugcauauaccacauauacuaacuacaugcacucacacacaccuaaaugaauaaaugaauaaauacaaauaaagcagaagaggcaaauugagagggcuuuguucuaucucagacuaauuacuaccccuuguuuucuugucacacucaaaacuuuuuuuuuuuuuuuaauuuauuuacuauauguaaguacacuguaguugucuucagacacuccagaagaggacaucagaguuuuguuacggaugguugugagccaccaugugguugcugggauuugaacucaggaccuuuggaagagcagucggcacucuuaaccucugagccaucucuccagccccucaaaacuuuuuaauauuaguuauucuuguaugucugcaugaucuguguaugagugcagcuguguggaggucagagggcaacuuucaggagucaguucucucucuccaccuuguguaugaguucuuugccugaauauguguaugcaccguauuuguaccuguugcccuggaaaucagaaaaggcugugggacccuuggaauugggguuauggauggucacgaguggccaugugguugcuaggaaccacacaugaguccucugcacgagcaccaugugcucuuaacugcuggccaucucucuagcuccucauucuugauggugaugaguacuguauguauggccucaaacaagccagggaaguacucuaccuuugagcuauaguccugguucccaguugccuuuugaauuaaaaaaaauacuuacaaacagaccugggagccacucuuucuugcuacagagcccaagaaacuaacuuaugcaugugggcaucccaacaguagcagugacugauagcucugccagcacaguggagacgcaacuacaagugaaacccaaggcugcaaagagcccuuuguucacaguacaccccccuggcgauacuaaaauaauggggaucacugagcucccaaagugaguaggugaaacaggaagggggcacacgcagaugaagucucucggacacagcaauccuuugacaggacguccagauacagggaauugggaugaaguaaggaacuuuugacuuggcgcuggaagucuggcuguuugugggaagccguccuuuguuacacuuggacgagcuguucucucagugugucuguuuccuaaaauauugaauuucuguaccuuuuauucagcaaaagcagcugaggcuuuuuucuuaggcauuccuuuucuuuugccauuggguuggcugcucugaauaccgucucccacaaggguugcauuuccauccagggaagcuuugagaaugcucuggcaugccugcggguucaaggcugguguguuuugagcugugagcgauagcugauagaaacagaacuugaaauguaaauguuuagucuuguugggcacugcugagugugccccaccucgucuuaggauuuuaacuucuggcucaugucccaacaacaauaaaaaacaagcucaucgguucacauuuuucaguagaugugguuugcagaaaucucaaaugaaaguaacuuacguggaacagagcauuuuagcaaauaaggugagaacugcucccuuugcucagcacauucuuuugguucacagacuuggaaagaaaacuguacuguaaauaaaaccccuuuguagucugcauuucugaauggacuacagaggaaucagugugaacaccaguaauucuuaucucaugggugcccugugggcccugacuaaugcugcuagcccaguguguuauaguuugcagggaaacacaaugucauggucugggggcaacagggagaguucuuuagccucugcaacuguuggacaucuuccuggaaaagaagcugcauuguacuauugcugaggcuucuuggagcaccucugcuccagcugaggaugccuuguuucuauagcaacagcacugacugguugaauggaacaggguggccaacaguuccagaaaggacuuucuauaaauagaagcuacuuacuuggauauuucuaccauuaguggaugucauuagagccucuguuuagaacucagauguaucgcucgccagguucucuuacugaugcuguggaaugauucuuuuauucaaaccuccauguuucauucuucucuuucaguuauuuaccccccccccaccucacucuuucuguguguguagauuuguguacaaaugcggcuacauguacauguguuaacuagagguugacauuggauauuuuccucagcuacucuucacuuuuuaaaaaauuaguucacggagaucagaagaugagcugugagagucuguccucuccuucuaccugguagauucuggggaucaaacucaaguuaucaaacuuggcagcaagugcuuuuaccuacugagccaucuugucaucuccugauuuauuuuuuugaggcagggagcuuacagauuuagcuagauuggcuagcaaguccuggggauuuccucuuuccccuuccccggugcugggauuacaugugugcaggacuacacucagcuuuguauguggguaugggguucaaacccagcuccucacaugagugcuggaagccucacuuacauuucuuucuuccuucuuuccuucccuuuccuucucuuccuuccuuucuuuuccuuuuucuuuucucuucucuucucuucucuucucuucucuucucuucucuucucuucucuucucuucucuucucuucucuucuuucucccucucucucucucuuuugcuuuuuuucaagacauguuucucuguauagcucuagcugcccuggaacucacucuaucagaccaggcuggcucuagcucaaagauucuccuaccucugccucccaagugcugaaacuaaaggcgugcaccaccaccacccagcugcguauuuaaguaucuuacagguuucccuugaaaacuuuuaaaaggcuucucccuucacuaagcuucuucuuucagaucuagcacaguccauuuaguaaauauacuuuucuuauuuucuucccuuucuuuuuuuuuuaaucuuauuuaugguaggaugauuuucauuguuuguuuuguuauuguccuuuggcuuugggcguuggguuuugcugcauagcccaagcuagcgucgagcuugaguuacuccuacccuaaccucccgagugcugagcugaucacuguacccagccaggcacacagucuuuuuaaaaaaauuaauagucacuguuuuucugaagcaagcuugacugucaacaugcucggacgaugcuguucuccucaucguccuuccaggaugccggcaggugcuagacuuuaccaccuuguuggcaaagcuccuuccauaaaggucaccgaugaccuuugcauuccaucagagaaaucagggagcaauguacuaguugccguuuagucagcccuuucuaugagcauagcucucagacccaguuaggacuacagauuacaaagauaaagucccaguuuaaacugucuuaaacaaacaaaaugugggggaagaauugcuggaaagaaucuuguguagcuugcugugaaggaaguugaacacugcaccuggaaagugucuccaugggccuugucaaacagccaaggcuuagaccuggaguagugccugugugucggucucucuguguuggcuuugucucucccagggagccagccuccuucccucacuggagagcuuacugcugucuagucuccccuagcugcacaccuuccagcucuccuuccagucuagaaacaccagaauugcaucaugggacugcuccuuugauagggaacucuguaagaauaccaugagagggaaccugcaggagguggggucauauugggucaacaguuccaaagauuucaucaccaaaucccaggauucuuucuuacaaaagucuuuggaaagggugcugcuguuucuguucuagaaaccaugaagcugugucuccuggaggucaguggcgugacagagaucacauggcugaggucaagcccccaauccagugcuuuuaccaaguaaagcacguuucuuucccauguaguaaaaaggaaaagggaaccagaauuuagaugucaagguaaaguagcaaugacagcaaaguggcaggaaauaggauuuucuuuccaguaaccuuaaagguuacuaccuuaagguggguuuuuuguuguuguuguuuguuuguuuguuuuuuuuuuaaagaaacuuuuuuuuuuuagauuuauuuauuuauuauauguaaguacacuguagcugucuucagacacuccagaagagggagucagaucuuguuacagaugguugugagccaccaugugguugcugggauuugaacuccggaccuucggaagagcggucgggugcucuuacccacugagccaacucaccagcccguuuguuuguuuuuuuuaaaaaaagccaggugugguggugcacuccuuuaauccuagcacccgggaggcagaggcaggcggauuucugaguuccaggccagccuggucuacagagugaguuccaggacagccagggcuacacagagacacccugucucgaaaaacaaaaacaaaaacaaaaacaaaaacaaaaacaaaacaaaacaaaaaaagcacccaaagucauacaagaucuuuuaaagucaacagcaacaacaagugguugcaaaugggacaucaguuucugaagacugccuguaggcucaccagaaaucagcaauauaauucucugauaaagcuaacugcucaguuagacacaccuuagauucauccagaggcugcauaaugaucaggagcauugcugugggaccagccccucugucuacacaugugauaugacuggcuugcaggcaaagaaacaggaagggcaggaagaaaguagaggcaucugugccaggucccugcugcuucucuccuaugcuggugaccugguguggcagggauucugcucagugugccuaggaggcaggauacuugaaaggugcacauacgguguguggugcacagaaggaugagggugcucucauagguuugcugagucuuagaggcaaggucagugggucauuuugucuccaaguacagguguugaguucucaaagagggucucaguaggaacugcuguccagugacuccacagguucaggccaccaccgcacagcagugauccacucauaggcaccuggcagaggagaaacacauggugauucauucuguuuuuaaucuggauccaguuugaaaugggcaagugcuguauuuaaauaguguccagggauagagcuagaaucucccagcacauuuucugauuauuuauauaggauaugcauguuaguguuuuguuuuguuuuuuaacagaucuugccucaaguuuauguguaaaaacagcauaggacacuggucaucugcagauaguguguaguuggugugucccagcacuccagcuaucuucacauugguaggagccuuuucuauggggccuucacagggaccugggcaccuuugggagccugagcuggagcugaagccugggccuuagcuggagcugcggucuccgccuugguuuggaccuuggccuuugguuggcagagucuacgaccauuggccauguagcuucgaaucugcuucccaagcuuggagugagcgaugaaagccagguggcugacucugcggcuggggcccuuuggcaucaugggcuugguggccugaggcuucaccagggccuugauggccucugcacgugcacucacugccuuugcauugcuggccugcgucuucuucaggucuuucuuguugugcuucuuggcaaagcgcauguuccucaggaacuuggggucaacccccuuaagagauucgugucuuuguaaccgggguuucuugaugccauuuuaguagaacugguuguguguggugugguucuuagacuuggccaugucugcaugguaaaccauggcuguuuuuuguuuuuuuuuuaaagaagaaucuucucuuucuauagaccgcacacuuuccccggguaugaacuguucugugaugcaguugcuauuauaggccagauagcagauauuaggaugugugcauguuaagaagggacuuccucuguagagcaaaugcuccagaggaagcaguuugacucugggaaaugaauuacauucaauuucacccacgucgguacauuaucauaacaaggaaagacugaaaaaauaucuggcagaccauuuaucuuccuugaagucugugaaauagaagacugugugagucuuguuuucuggaagaggaaagcaguguccucaguggcaggacaguagcucuuucucccagccuuggugcuuaguauauaaccuguccuuuugcaugucacuauaacauagcaugccuuaaacaucacauacaagccauggucaagaaggcaagucuuuccuaaugcucuguuuccuacaaggccucuauggucuuuucaacaucauacucaaaagcacuuggaagccuccagugaguuuagaauguacccaccacucuucuguagcagcaccuuggcauuaaaaucaguuaccccagcagaugcugcugaucuaaguguaaugcugcaguugacuuugaaccacugcuuauagcuugagguugugcuugaaguugggggaucaguagaacacuaacccugaugcagaauaguuuuagcacugccacucaacacugacauuuaaucaucuggcaaagauuuauucaauuuuagcugugcuauauagcuuuggcuagaugcccuugguaaagggcuauauaacucaucaccagggccauguuuacucuaauuuuauuuuauauguauggguguuuugccuacauauauguauguaugugcaccauguguauggagaagaaggcaucagaccaccuggaacuggaguugcaaugaguugugaguugcccuguuugugcugggaauugaaccuggguccucugcaagagcauccagaguguaacugcugagcugucucugcauauccaccagagccacuuuugagaacaagagggagcuauucauaauuauacugagacauacuaugaccccugcguuaggcaguugagguagaaucgugguuugagaccaaccucuacugcauaaugagacuaugucuuaaguuacuggcucaguuaguggagugcuagccuggcaucuaggaggaaagcucuggcuuugaauccuauaaccuuuuaauaccacaugguaguaauuacaugucuguaauccuggcacuagagguaggagaaguaaauguucaagguucuccuaggcuacauagugaguucuaaggaugccugggcucugugaaauugugccucaacaaaacaaagcauugcaagccaaucuaaaauaauaguaacaagaauaacuuguugcagucaucucuuaguggaaguaggauuauccuaaucugggacaguugccuuguacauucauguccuucaguauguacaacuguuacacagcuaguuaaaucaggggcuuuauaaaagcccuggguucuguucuuagcacugaaaaaguaaaaaauuuauauauauauaaacauuuccuccuuuucuacaguuaucccagaaccucacaaccaaauuuccccuuccgaacuguuuacauggcagagugugcaggcaucucucacuucaagaauucugccaucugguggauuucugaguucaaggccagccuggucuacaaagugaguuccaggauagccagggcuacaacagagaaacccugucucggcaaaaaaaaaaaaaaaaaaaaaaaaaaaaaaaaaaagaaagaaaaaaagaauucugccauccaucugcugcugcucuuccacacguccucagucauagcaaaaaacuuacagaagaauagugugcuggaguccaacaaaucucucucccuccccucccucccucccucccucccucccucccucccuccucucucucuuuuuuuuaaaaaggucuuccuccaacucuuaguaauccuccugccucaggcacccaagugcuaugauuauaagcauuagccaccaugccuagcucaaucagccauuguuugccagcccagcuuuguaucaaugcucugcaccaugucaucauagucugcuccccugccccugucugcuuuugucacaguucccagcaucuucccuguugucaguggcaguccucugucuugaucagguguaaggagugauuacucuucuucagcucaaacacuugucuggguuugggauaaacauagucauccuuggcuuucucugcugacacuggcuucucuugugacauuuugcucccuucuuuucuucuagacagcugagcaucggaguaccugagggcuugguucucucccccuucccucccuuucccucuccucuccuccaaggcaccuaaucagaacauacgugagugacugaaagagugaaugagauucugacuggugugacugagcagcuguguugccguggguuuucacaggccacaaagucuacgagcucuccauguguguagcuguggugcucuucccucccuguccccccaucacaggagauguggggguuauaacaguuuuaaugugucccauccaccuaugugggguuuaaguuccuugcaaacauuugguuuacuacuagcuucaaaugaaguccuucugacuucauuucaucgguuucuaaguagcacaccauaaauguccaagaguugccacaagucaguggcacagucuuuuagagccauuauguacaugaggaggcagaucucagcaaguauccagagcuuaccucacuucuuuuucuuuuugguuuuucgagacaggguuucucuguguagcucuggcuguccuggaacucacucuguagaccaggcuggccuggaacucagaaauccgccugccucugccucccgagugcugggauuaaaggcgugcgccacuacucccagccgcuuaccucacuucuaacuuggagccacugcugccuuuacaggugugaaaguuuguguacacacugaaagacagauguguauccuguuuuuuuuuuuguuguuguuguuuuuuaaauuuuguucaccaugucuaccaacucuuuuuucuuuuuuaauauuuuuauuagguauuuuccucauuuacauuuucaaugcuaucccaaaagucccccauacccucccuccccccacuccccuacccacccacugccccuuuuuggcccuggcguuccccuguacuggggcauauaaaguuugcaugaccaaugggccucucuuuccagugauagccgacuaggccaucuuuugauacauaugcagcuagagacaagagcuccgggguacugguuaguucauaauguuguuccaucaauagaguugcaguucccuuuagcuccuuggguacuuucucuagcuccuccacugggggcccugugauccauccaauagcugacugugagcauccacuucuguguuugcuaggccccggcauagucucccaggagacagcuauaucaggguccuuucagcaaaaucuugcuaguguaugcaauggugucaguguuuggaggcugauuaugggauggaucccgggauauggcagucgcuagaugguccauccuuuugucucagcuccaaacuuugucucuguaacuccuuccauggguguuuuguucccaauucuaagaagggacaaaguguccacacuuuggucuuuguucuucuugaguuucauguguuucacaaauuguaucuuauaucuuggguauucuaaguuucugggcuaauauccacuuaucagugagaacauaucauuugaguucuuuugugauuggguuaccucacucaggaugaugcccuccagguccgaccauuugccuaggaauuucguaaauucauucuuuuuaauagcugaguaguacuccauuguguaaauguaccacauuuuuuguauucauuccucuguugaggggcaucuggguucuucccagcuucuggcuauuauaaauaaggcugcuaugaacauaguggagcaugugucuuucuuacuaguuggaacaucuucuggauauaugcccaggagagguauugcgggauccucagguaguacuauguccaauuuucugaggaaccgccagacugauuuccagagugguuguacaagcuuguaaucccaccaauaauggaggaguguuccucuuccuccacauccucgccagcaucugcugucaccugaauuuuugaucuuagccauucugacuggugugagacagaaucucaggauuguuuugauuugcauuucccugaugauuaaggaugcugaacauuuuuucaggugcuucucagccauucgguauucuucaggugagaauucuuuguuuagcucugagccccauuuuuuaaugggguuauuugauuuucuggaguccaccuucuugaguucuuuauguuggauauuaguccccuaucugauguaggauauguaaagauccuuucucaaucuguugguggccuuuuuguguuauugacggugucuuuugccuuagagaagcuuugcaguuuuaugaggucccauuugucgguucucgaucuuacagcacaagccauugcuguucuauucaggaauuuuuccccugugcccauaucuucgaggcuuuuccucacuuucuccucuauaaguuucagugucucugguuuuauguggagcuccuugauccacuuagauuugaccuuaguacaaggagauaggaauggaucaauucacauucuucuacaugauaaccaccgguugucccagcaccauuuguugaaaaugcugucuuuuuuccacuggaugguuuuagcucccuugucaaagaucaagugaccauagguguguggguucauuucugagucuucaauucuauuccauuggucuacuugucugucgcuauaccaguaccaugcaguuuuuaucacaauugcucuguaguacagcuuuaggucaggcauggugauuccaccagagguucuuuuauccuugagaagaguuuuugcuauccuagguuuuuuguuauuccagaugaauuugcagauugcucuuucugauucguugaagaauugaguuggaauuuugauagggauugcauugaaucuguagauugcuuuuggcaagauagccauuuuuacaauguugauccugccaacccaugagcaugggagaucuuuccaucuucugagaucuucuuuaauuucuuucuucagagacuugaaguucuuaucauacagaucuuucacuuccuuaguuagagucacgccaagguauuuuauauuauuugugacuauugagaaggguuuuuuuucccuaauuguguauccuguuucuuaucaguaacaaguauuguaaucaccaaaauagagaaaaugguuuaguuuuaaauaaaacguuaugccaagcauuguagcaugugccuauaauuccagcacugagaaaaacagagguaggaggauugcugcaaauuugaagucagccuagucuacagagagugcuaguccagccaugacuacauaaugagacccugucucagaaaacccaacagguaauuugcauguuacgaugcauauuacuaagagucuuuagacuucacuugugcccauacaggaggcuuuaucuccuaugcuggugcagugaaacuauagguguaagaacagcaaaucaagaguguuucuggucaaaauuuucuagagaccgagacugauuauagugacuagugcuuccucuccuugcuucuugguuuucaacuacuucuuuuauuauaggcacuugaagaggcccagaaagccauucagcaacucuuuggcaaaaucaaggauaucaaagacaaagcagaaaagucagaacaaauggugaguuuagauuucauccagucccaguaauuaccaggcucuucuuuccccugccugccaaucauguaucccugucugugagugcaccccgacugccucagaggagcugcugcuagacaugggugacucacuggccuugcugaccuacauuugcagccacuuuccuauaggaaacaauugguuuuccuagaaaaucguuuccuggucauuuuggaugcuguucuucagcaugucuauagcauguuucacaguuaagauguuguagucugguacacaguacacuaaugcugguuccgacucuggggugaagguaccaugcccaugaugcaugcacccagucuucuuuaguuccuccucuuuguaggugaugugcucccaagucccugcugaccgggaagccagccuucaccacagcugcuccucuggugccacuaggcuacacuggguuucugggcugagauucuaagucaugagaugcaucuaaaugacaguuuucucaauaugaaauaauaucugcuuuacaagggaucugagcagaguaccuaagggucugcauuuuuuggaggaguacaagauaugccaccaaacaguaugacucuagugaagaugacauuugcuggaguuuguuguacuuaauuuuguuuguuuugacucuuaggguuuuacuauguaucccugaccuugaacucaguguagauagggcuggccuugaacucacagauauccacuugccuuugccuuuuaaacauucagugguuguacucagcuuuuaugcucagcaauaauguuauguuucuaagcugcuguucgagauuguguucccucuuugcaagccucuguaacugcaguuccagggacucugauguccccuucuaggcacacagugguacacagacauauauacaggcaaacauccauacacagagaacaaacaagugguuuguuaaagccuccuagaugauagucaggcaugguaugugccuguuacucagcacuggggaagcuguacagagacgauccuuaaauaaauaaaaagaaacugagggggugcuggagagauggcucagcaauuaagagcacugacugcucuuccgaagguccugaguucaaaucccagcaaccacaugguggcucacaaccauccauaaugagaucugauguccucuucuggggugucugaagacaccuacaguguucuuacauauaauaaauagauaaaucuaaaaaaaaaaaaagaaaaagaaacuggggagaugacucaacaguaagaguacuugcugcucuuguaagggaccuaguuugaacagcacucacauuaggcugcuuacaaccaacuuaacucuagcaccagggcauccagugcccucuucuggcaccaguuuacucacauauacauaaaauaauaaaaaugaaucuuuucuauuuuccuuuuuucuuuuucuuuaaagauagucucucucaccaggugguggugguaguaguauacgccuuuaauacaagcacuuggugggcagaggcagguggagcucuguuugaggccagcuuggucuacagagcuaguuccaggacagccaaggcuacauagcaaaacccugucuugaaaacaaacaaauaacaacaacaacaacaacaacaacaacaacaacaaaagauugcaucucugcauaacacuggcuggugaaacucacuauugaagaccaggcuggccuugaacuccagagaucugccugcaucuaccucaugaauuaaaggcaugaaugaacacacccagcccaaauguauauuuaaaaaaagagaaauaagcaaacaaaacaugaaaggggcuaauuauucuaaguuauuuuaguuuuguauuauaagaguauuuauauuuuuucuuaggggcuaaccugagguuguuuuaagugauuuuauaucugauuuucuuguagagugacuugaagaaggguuuaaagcuuucucacccuuucccuguuuucuuuucaauguguaggugaaagagaucacccgagauauuaagcaguuagaucacgccaagcgccaccugaccaccucaaucacgacccugaaccaccugcacaugcuggcaggcgggguggacucccuggaguaagcagugugaccucucaacgggcccacaggaaaugcuccacaugaggacaguggcuucagaguuacucacuucccagccgagccagccucaccauccucuccauguuuggaacacugaccacaaguguucagucacuuuugguguucacaacuuaacaaaagagauggggauguagcccaguggcaggcagaauaccugcuugacaugcccacagcccuggcuuccauccucagaacugcacugcagcagacagucugucuuaguaaaaaaaaauggacaggcaaccugaggaagccacagaaagcccaugagaaugacccugaaaaaugugucaucucaugugguagaucuagaccagaaagucagacagagugacucagccccagucacucucuagggccucugccuuggcaaguaucccuccuucuauugggcugaguuucauuucaccaaagagaccauuucuaaacaaaucuuugacauacaguuuaacccacuuuuuucuuaaaccuauguuuuuaagauuguaguucuuugugcagcacauuuagaaagaguauuaaaagaaguccccggccauuuaccuugaagcaguguuucaaauccuccugccccagcaccccagcuuccuacugcaaugggucucaggccgauucccccugcuuuaguccuaguggaauuucucaugugugcaagccugccaucuucacagacaugcaggucuggcaagaaugaaggaugcccagaaggaaggaggagagguuguaucauuccuaacugcugcugggcauacaaaagguggcagaggagcccuaguccauuggaggagugaucauccagggcagcuagcaaaugggacugcaagaaccaucucccuuccuccuucccaugggacacuuuguauuagcaggucaagauggcaauggaguaccaugguuugaccuugagccucuccuugaaauguuuuauaagggaauuacacauuuaaugugaaagccaguguagaccuacuaguuuguacuucauuaccauguauaacuugauuuuaucagcaucguuuauuuaagcuucauuacccuuaggaguagggcaaguugucaucucagcugccauuguuuaucauuaucuuaaaacuaaaugugacaguuaacuugaaaucacaaucuuccuuuucugugauccagaaaaauggcuugguuuuuccgugcaccacaaucaucaguaauauuuuauacaacauuaucucaaaaucccauucuucaugcaaugcccagcucaaacccauagucuucccagaguccccucugccacccacugagcgugugcgcgugcgcacacacacacacacacacacacacacacacgcacacacacacacacauuuuugugcccuguggcuauaguuuacaauauuauuuagaccauacuuuacucucuugcuauuaguuaaauguuuacuugacacucccauuauuaaaugaugucaccuugagaguuggagcuaaauccuaaucuuuccuuccccaguacuuauacuaaaucuagcucuuguagaucaucccacaccugcuaucuugugucuucagagauaucugggucucgcaagucgucccacgucuucuaucuugucucuucagugacuacgucucaacuucuguccuugcagagccaugaccaggcgcagacaguauggagaaguugcuaaucuccuucaggguguaaugaauguucuggagcacuuucacaaauacaugggaaucccacagauccgacagcuuucugaaagguaagauauccucacagacaauggucuuuccauaagaaaagauggugcugcaugcuuucuccaccuuauucuaggaagcagcugcagaugcuaugugaccucacccuacagugcccuuuauaccuugucuuugcagccuacccaagucaacuaguacacucauguguauguaugugugugcacaacucuccauugucugcagaacuguugguuuaaaauaguuauuuugaucauaagacuuggccaggcuuggguaauauuucuucucugcuccagacaccaucaguuaaggcagcugaagauggaaccagaggagcuggcuaccauggcuaguaaaugauguucacugucagcugagaacucagcuagccuauggacugagaucuguguuguccucaugggugucucaggcuuucucauaguaggacgguugagcucuaaggaugauagcaccaaaagaacugaaccuuugaagccuugugacaucacaaagccacugagagucaagaggaaaaaaacaugucuuuccuuuuccucugaugaaugucaguggcacacuggugaaggcagcaugugggguggauggaugcuguggcaggcuuuagacacacuggugucaaacauuacagggaggaguuucucuuugaucuugugcuuucuuucuaccauccuugagguuucccuguauaaguacacuauagcugucucagacacaugagaaaagggcuucagacccauuacagauggcugugagccaccaugugguugcugggaauugaacucagaaccccuggaagagcagucagugcucuuaacugcugagccaucucuccagccccacccuuaagcuuugguccuagguucagauccagugagaagguucuuaggaggaaaaagaggauucugaagaagggaggggagagugaguucagugccuuucgccuuuucuauuagagauaaccacagaaagaaaaucuaagaauccuuaaccuuucuccaagcaaaggcagcguggcccccagcugcacuuuuucauucugccucauaggaagaccugccugccacacauguccauucuuuguuuucuuuauguaauuauacaaguagcauaaauacacaauugcuuuuauuuaaaaagucuaaacuggaugugaauggcuuacaucuguagucccagcacucaggaaguugagcuagagaacugcuuugaauuugagucuagccaaggauuuauaaugagaccuccuuucaaaauacuaacaaagaaaaagacaaaaaauaaauaaacaaguauaucucaguucucuuagcuacauuuccaauccuauugcaccuccuagaaggaguaacugcuauuagcuuguucucccucuagacugucuccucugcacuuauggugagcuauagaacugccucauucuguguguggacuaccauaggauagcaugucccaggcuaguuugcugucuucaugucccuagagccuuauucugauucuuaagacauaccucuucucacaugugugcaaguagaucuaaagccuuuaaauuuaaaaaugcauuuaaaauuguaauagccaccacucauuuacucccccacaagcuuuguagauucacaauaccaucuugaagugcugaguacccauuccuccaugccuugaacaaaugugguauugcugauuuuuauuuuagucagucugggagauggaagucucuaucuacuuccuuuaauuuuaauuuccuuaguaacugaugauugaccauuuacauuuccucuguacaguauuuuguuuguuugguguucauuugguugguuugguuuugagacuuggucucacuguacaguccuggcuuucuggaacuugcgcagagaucugccugccucugcuuccugagugcugggaugaaaagugugugccaccauaccugacucagauuucuuaaguucuaauaaacuauuuucuuuuauuucuuucuuagagugguauuugggguuuguuuccuuuggucucuuguuuuggaacuccuauacacgaacauuguaacuuguaaccugcugccucaucuuuugggguugcuuucugaguugugggcucagucuuccaguucuaccuuguucuucacugaugcccacucuguucuuuggcccagcuauuaagaauuuuuacugaaacagcagguuuuaauuucuaaaauaucuagaugauuuuuuccucaggggcauaauauccucugaaaucucucagagauucaaaacuguuaguaucucugaaggcucuggguugccuguguguuugucuguccugugguguaaggucuucagcuuguugacucuugguaguagcacucagauguuuggugagucucagcugaaaguucauauuuuuuggugggauuuuaaaauuguuuauuauuauuauuauuauuauuauuauuauauguucucuauuacucugaucagaaaucauuaccaccugcuauugaggaguggaaggauauuguguuuaggguaccacauagcuuuucuaagguuccuggggccagaccugcaggagcuggcagaugacuugccaggcaccugaucuucuuaaaugcugauaacucucagaccucugcugagacucacagacccaaggggccaaaucaguguaaggcugagcauuuaggguaagaaagcagcacagcuucuggcauccacauuacugugacuggagccagacacaucuagagguucccuuuagaacucccccgcuccuggugucuaucauuuccugucuuuccuuauauuuuaucuggcuuuuagauugugugcaccaugugugaccugcaucuguagguaugcccgugugugcguuuagugccuauguuugucagaagugggcuuugaauccccuagagcuacugagaggaaguuguuagccaccauguggguucugggaacugaacccagaucuucugcaagagcaaaaguugcucuuaacauggaagcguuucuccagcuuccaugucuucucauuugugagaaacacucuuaagcuaugauuuuguucuaccaggaaacccacagacagucuaaucuaccaguuccccuuuugccugguuuuugguucuuauuuaagucuuuucaucauuucuaagaaucugagacaggaagggagguuucuguaugugcuagguguaccgucuuacaguggagauguucagggacucuuaaggaaugucggaauaggcuuggcaaaguguuagggaagucgccacccuuccccucguccuuccuaaccuuuuuacacuuagagguggcugguugccauaucagacugggaaucugaaacagccaagaauguccaugagcaggaugucaugaguuuaggagaguaggacccauggguggaggaagcugugcucucagugguuagggaggagcaggaagguggcacagccugcccuagucucggugacucagugaucugguguucccauucuuuuauccuuucugucaucugccugcauuaaugugcuguguggccccuguuuccugggcccuaugaauucuaagcacaugcucuuccacaaccccagcccuaccugacaccccacacccagcuuucugauucauaguuuaaucugucaguguaggcccacagauaacuagaacagcuguauuugacuuuaguuuuuaaagagucuacaccuaagagagaucacgccauauuuaucuuucugugucuggcuuauuuacucuaaguccucugaguuuauccauauuguuucaguugucagcaucuucuuuuuaaaagcuaaauaaaaucucacuggauauaugcaccuuggaucuuuaaaccauaucuguccaucaaaaacaauguuuguuuccauaucuuggcuguuguaaacuucugugagcagggcagggcagcuaucuguauagaguggauaucauuuccuuuggguauauacccuauguagauucauuuugggguuuccgagagccuucaugcuauuuuccauaauagcugcaucacucaucaccucugcccugguguccaaguguucucaucuuuacauccucagcagagcuuaccuuucuccuuacuuuugauauuagucauccugaugaccuguuaucucaggguuggaggcagagaugggaggaucaggaauuugccaugugagacugucucaaaaagaagugaaguaauaucucauugaagguuguuuuuuuuuguuuuuuguuuuuuguuuuauuucugauuuuuuuuuuguuuguauagaauagaguuuauuuagggcaugaggagggaaguuaagaggguaguagaggcagagaaaggcggagagaaguagaggcugaccauggccauaagcacaugaaaagaggggugggggaaggggaugggaaggagagaggaagagcaagagagcaagagagagcaagagaacaagaguuauuucugaauuuuuaaaaauuauuuuacuuauuuacauuccaguuguugcccccuuucauuucccccucccacaguuccucaucccauuccuccucccaccuaccuccgagaggcugcuucccccacccaauugaccccccuucccuggagccucaagucucucuaggauuaagcacaacuucuccgacugaggccagaccaggcagaccucugcuauuuaugugccaguggccuccgacuagcccgugugugcuccugguugauggcuccgucucugagagcucccuggggucuggguuaguugagacugcuggucuuccucugggguaggucucccuuccagcuucuucaauccuuucucuaauucgaccauaggggucuccaacuucaguccaaugguuggguguaaguaugugcuucugucucagucagcugcagguagggccucucugaggacagccacgccaggaucccgucuauaaguacaucauagcauuguuaguaucagccuuggucccccacccgacccccuaugagaugaaucccaaguugggcuagucauuggaccuccuuuccuucagucucuucuccauuuuuguccucgcaguucuuuuaaacagaaacaguucugggucaggaauuuugacuguggauuaguaacccugucccucuacuugaggcccugccuaucuacuggaggugacucuuagaguucccuuuccccaguguugggcauuuuggcuacugucacccccaaugaguccugagagugucucacuucaccuccugugucucugguacuuuuuacaggguccucccaccuccugcuuccugaagcugcuuauuuccauucauauucuuggcccucugggcuucucuccugucuccuccccccauaucugauccuguuuccccuuucuccccccccccccacucugcccucucccaccuagauccccccuucccucugccucccgugauuauuuccuucccuauucuaagugggauugaagccuccucacuugguccuuucugcuuguuacgcuucuuacugucuguagguuguguccuagguacucuguacuuuuggcuaauauccacuuaucagugaguacauucuacgcauguccuuuucagucuggguaaucucacucaggauauuagcuaguuccauccauuugccugcaaaauucauaauguccuuguuuuuaauagcugaauaguaguauuccauuguauaaaugaaccacauuuucuguauucauucuucaguuuuuaggauaucuggguuauuuccagcuuuugguauuacaaauaaggcugcuaugagcaugguggagcacgugucuuugugguaugguaggguguuuuuuggguguauugccaagagugauauaguugggucagauuuguuuuauuuuuauuuaugcauguguguguccaggugacuguauauacauguguauguauauguuggauuccuuggagcuggaauuaaagguguuugugaacaccuggcaugggugcugggauaugaacucaguccucaugacuccuaccacugagcucucuagccagcuccuguugguuucuaaauuucuuuuuuuuuuuuaaagauuuauuuauucauuauauguaaguacacuguagcugucuucagacacuccagaagagggcgucagaucuuguuacggaugguugugagccaccaugugguugcugggauuugaacuccggaccuucggaagagcagucggguacucuuacccacugagccaucucaccagccccgguuucuaaauuucuauuugguugguugguugguuuggcuuucugagacaguaucuaaguagcccugacuguccuugaacuugcuauguagaccaggcuagccucaaagucucagaaauccaccugccucugcuuccugagugcugggauuaaagguguuuacuaccaaaucuggccuccuuuuggagguuuugauuugaguauacaucucuggagauaaaguaauauugaacauuuuuuucauauacccuguugauuuuaugccugccuugaaaaaacacauauuuagauccuuuaccuaguuuuuuuuuucuuuuccauuuuuuauuagguauuuagcucauuuacauuuccaaugcuauaucaguagucccccauagccacccacccccacuccccuauccacccacucccccuuuuuggcccuggcauuccccuguacuggggcauauaaaguuugcauguccaaugggccucucuuuccagugauggccgacuaggccaucuuuugauacauauguagcuagagucaagagcuccgggguacugguuaguucauauuguuguuccaccuauaggguugcagaucccuuuagcuccuuggguacuuucucuagcuccuccauugggagcccugugauccauccauuagcugacugagcauccacuucuguguuugcuaggcccuggcauagucucacaagagacagcuacaucuggguccuuucgauaaaaucuugcuaguguaugcaauggugucaacuuuuggaugcugauuaugggguggaucccuggauauggcagucucuacaugguccauccuuuuaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuuggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucucuuugccuaguuuuuaagacuacauuuauuuuauuugggggugagguggggugguguuugugugucauggcaugcaaauggaggcuagaggacaacuuugggaaugguuuccuuccuucugucaugugaguucccugguucaaacucaguuccucagguuugguggaaggcaccuuucucucuccucaucuccccucucagcaucucccuucucagcgucuccccugaccucuuugccccauccuuuuuuuuuuuuuuuuuuuuuuuuuuuuaaagacagcgucucagguaucccaagauagccucaaauucuucauguaacugaaugaucuugaauuucugaccuuccugccugcaucuucugagugcugggacuaccggcaugugcuccaaccugguuaugaacccaggagugcuuagcuagucagaugcucuaccaacuuaauaugccucaaccccucaaaagaguuuuguuuuacuuugucauuccaagcuauuuauauauuuuggauacuaaccuuaaugaacuauaagguucucgguauuuucuccugauucauaggcuaccuuuucauucuguggauuguucccaagcucuguucaguuugagacaauuccauugcuuuguuuuuuuuuugucugucugucugucugucugucugucuuucucucuuucucucucucucuuucucuguguucuuagugugcuaugugcuuuuucaaaaaacaaauuuuuuuuccccaagcuggagaguugucucagguuaagagcagucauuucucuguagaggaucgagguuuuauucccaucugccuuguggcagccccacuucugagggcaccgagcaugcauguggugcacagauacgccugaaaauggaaagaaagaaagagacccccacacaauaauaaaauaagugaaucuuuuaaguucucaaaggugucaucuuuauaaauuugcagaaacuuggagaguacuauuagagagacaucucugaaagaagugguucucagcagcccuaaagcugcgacccacagcuccccgggcugugugcacucacagcuguaaaacuaucuuguugcuacguauauguaggcgaccugauuugcaacccuugugaaagugucaucugaccucuccagaggggucgagauccacagguuaagccaccuucuuaaacucaugcaagaggaaaacccuguauucuaucaucugugucaguggugcaaagcauucccaacucuuggcuggccuuccucuucguucgucagugcgauguguccuagucccggcgcugaagggaguuuggugugagagcugcuugccugccugccugccaucgguuuucagggaggcgcugacauuugagcaaaguccagaccuccuauuuuuagcaucauuucuagugacuuguccuccuuauguuuauauagugaugguagaaccaucuggaaaugauagaaauaaauguuuguucaggaggaggggaaaaagccaagaguuagcccugcgcacugcuccaguguuaauaccuugcugucuauaaauugcacaagucauccacaagauuguauucucaagucuuggccuguacauuugaaauaugaaguucaugggccuugauuugcuauuucuuucaacuacccuucuggcaaaugccuaaauguuuaauguagcauugaaggaaaguuuuuuuuuuucuuuaauaucuuuacauuucaaauccuccuggcuuaagcauauccacgggggcaaaugcuuccagucaguaaauauuuccugagaaagagcgagagauucuugcauuucuuuaaaaaacaaacaaagaaaaaagccuuggaacccuuaaauuauuuuuuucugcccucagagcgagucaggcugguuggaucugacuagcuuugacaggcucugucugggccuccucagauuaagcuguaagggaugcuuguaaugaucucagagccuccugccaggucuuugcaaccaucuaguugaaauucuugguagcaccuauucugucauaguauuuggcuaauccacuccacucaguaaaggcauugaguggaaggucagaucaccugauuucagaacaguggagagcauuuucuuugagugucacagauauguaaaaguccgguuuuccuaguuugcuguccuucugccacuacuccuuaugauggauacuagacuuaguaaagggugccuuuggaucucugaugucacacuucauggaugaagccagaagccacucacugauuuucuuuucuaagcaacagaaugcuucauuuccuaguaguaaccaacuucauguaacugucacacaacaagcuguuuauuuggaugccaggaagaacuuuuuguuuguagcuggacagggucucucugcauggcccugacuauccuagaacucacagagauccaucugccucuguuuucuaaguacugggaguaauguugugcaccaccaugcucagcugcaaaaggaacauuuaaucuuuccugccucucuguuaggcauugggcugaugauaagccugcuaacuuauuucuaggauccuguucagacaauugauuacuguguuaguuucugcuacugcgaugaaauaaccaagaaaaacaacuuuaaaaguaaugguugcuagauuaguguugcaugccuugaaucucaguacucaggacauagaggcaaguagaucuuugugaguuugaggccaacuugaucuauagaucauguuacaaaccagccaaggcuacuuucugagacccugauguuguuguuguuuguuuuguauuuaaaggcuuauuuuggcugauggguucagcccacugaccauguugcuucugggcaacauaaauaaggcagaggaucuuguagggggucaugaugccugucaccaccccugacaaccacaggucaacccuucggaccauaugcuagggagagagaaucaacuccuacaaguuacccaccccuuucucuuucuccuucgagagcacuacucacccagccaugcuccgucuccuuguuccaucauuucccaauaauccaauuaaauuaucaaucuaaugaccaaaucuucaacacaggaaacuuuuggggaauaguucacaagaaacuguaaccacuauggaagguguggcucacaucucacccagaaaaugccugugaaugagaucugucuuugucaauaaugucuccaggggaagagccgcucuuucaucucagucacugggagacacuuuaacaaccauugcugcaaacaauucuaggcagaagcuuuucuucuggccaauauuaauuauguauccacuugucaccacuuguaaagguaggugcuguugccagcuagaacugucagcuggguauugugaaauaguuaggacuggaaagacucugaagucuuagcacaggccuccaucucuccauccucacccuuuauucccucccucccuuugaacauuaguuagaaaucauuacauaaggaagccuggucuuuuguacucuaguaccaaggcccaucauagacugugguugucuuuccagcacugugguguuaaaaucagcaagaacauagagauuggcaauuguaauagacuaggauggggguaacagaggcagagcuuagugcagcagucuuguugagggguggguagcccugaauaucugcccauacguucuucuggucaggggugggccucacccacagaauuauguggcucaggaacaaacugguggugucuuugugcuuccaagaagagggucagagcagagaggcaauagcaucaggaucuuugccuugugacccaguucuacagcagacagccugggaagucgcaagaugcucugaaggacaauuuuaugaaaguacauucuuuucucucacauuauccuuuauacuuaggggaaguuucccgaugucucugaggcaacuccaggugggggugggguagauuccagcacagccauaucuugaacacaaacugaaaagaauauaaacucuucuauaggaaugguuuggaacauuugaagauaguggaaaaacccuggaaaguauuuggaaucaggcaugauuauaacugugccacaggaagaaacugaguguucugggucaugccuauccucucguuaaaaauaaaaucucagccccuugccagguucuccuaaguagccaaagaaauugugguuucaaguucacuauugcuagaaacuuuguaaaucaauccagaaguuucaggguggaguccaagaaaggaggcaugcuguuucauggugcuuuuagcaaagcaagucuuuaccucaggcucagggaaguucaacagcugcucaagagccucacucuuuagcucuguuucuggcugggacaagccagguaucaugaggcgaggcagcugucaggacaaggaggacaugacaugaucacagugcuugcugaugcgcacguccuguuucacuccagcacugucuccuuccccuucauccaccauucaugcugcaucguuccugaucacccugcaauccugcagacaccaucaagaaccagcccaccccauccuucugcuuaguuuuccuuacaguucaguuuuauucucuugaaguuaaaucuucauccagugccuauugcuuguuuugccugucuuguuuuguuuugcuuugugagacaugcucuuaugcaucucacucuggcuuugaacuugugauccucugcuucuaccuuuucagugcugggauuaugcccuucgaaguuaauaaugcccuucacuuacaaagaaccguucacuggucaucucgcucuuuuuucuuuuaccuuagagaacacucuuuuuguuguuuuaaaguauuuuaaaaauuaacauauuauauuaaaauauuaugaaaagcaaauauaaaccacacugaaacagucugaagcacucuucuaagccugugucccacagaacaggaaacaguuguuccagugacacaauagguuuguguuuggucaggcugcuguuauauuuccaugaaauguuauacacguucaaucuagauaccucacaguagggaagagugaccuagaacuguguccugaagggcuggcaguaugcucagugacagagcacuugccucccaugcccaaggcauagguucaaucccuagcacuaaaacuaaaaauaaaaaauaaaaaaguaaaauaacacauccugaaaugcugaucauaacccugcuucugugugauaucucuuucccagcugucuauaccuuuucauucccagguaauuaccugcacagacauagagaccgccauaguuccugacccuguggguccaugcacacuuguauaugaggauuugaaaauggcgccagucauuaauacagucccuucucccucccacagggugaaggcugcacagacagaguuaggacagcaaauccuggcugacuuugaagaagcauuuccuucgcaggguaccaagguauugguuuguauuuugccucugauauuaucacuguguucacacucccugcagggagaaugagguacccgagugauaacucauguuguaucacccacaaguguuggcuggcacaggccaagggucugccgacucagaugagccuguuuuaugugucuugauacaaugccgauuguuugucuguccuucuagcaucagaaagaggacucaggccaggaauguugguugguagaauacuuaccuaagcaugccugaggccuggguuugaucauuaaccccaaauaaguuggguguggugauucacgucuguaauccaagcccuaggaagguggaggcaagagaaucagaguuggaauucauccuuuccuacauagugaguuugaggcaaccugggcuacaugagacccucucucugggaaaaauaaaugggcauucauuugguuuaauuuaaugugugucaagucuuguagcuugucugcccaauaaacucacuccccccacccacauagcuguguguuuuuuuuucuuuuuaaaaaaaaaaaaaaaagaaccaaacaaacaaacuuuaaacccuaauguucuuaggauuguuacauaacacugguuuugguuuggugaaaagacaacugggaggcaugucugggagcuuauguaacucucaugacagaguccagagacucacuuuuaaugaugggaauccuugucccugggauuuucgagcucgcuggugguggaguugucucuguugugucugugaagccuacaggcuucgccugggagcugcuggguccaugucucacucgggcuccccuccccuggcugucacugugcugcuauuagccccauccuucacacugcagcagaugucaucuuaaugcuuugcaugugucggguaggacagaacccgcagaggcuuguuuucucuauuauuugagcuauuucaagagaaagcauuguugaaggcagaagugaagcagagcacccggccagcagcauuccucggcuagccacauuccucuccgggcuuuguggguggagauggggauggauauacauucgcuugggagccaaggagcauuuccugaaucugcucuguaauucaauaacuggaaauaucuuaaucgcuuucccucugugcuacauuugaggaaauagguggggauggcagcccuggcuuugagauugcuuucuauagaccagcuccugaccuuaccgccuucgugcuuugcagcugacugccaggaauaugaugauuugugaggccuuuacuuggagacccucaucucgcuggucaccugaugugacucaggaaaggaagagacuggaaagccauguucucguuggcccuauaggaaaagggaauucugagaagcagaaagagggugccuggcuaguagcuacuuuuucaaguuaguggcuagguuugaacaguugucuuccuaggcgacugccuuucuguguucucugcuccaucccauugcacgaugcuucagaaggauacgagugaagauugucuuacuguuugcccaucaucuagcuauggcccuucuacucucucuccuaggucccaguugaguaugauguuaaaaggauuuguuggcuuuauuaccuuuccuggcuguuuccugauggggaauuguuaaaaguuuucuuuuuccauuuuaaaaggcuauugauuuuuuucuacaaguccuugcaauacuaauuuacaagguuugcaaagucgaaccaagaauuuuuuuaaaguauugauugguggguaugccuaccaccccagcauccuggagauugaagcagaaggaucaugaguuagcuuggacuacacagugaguucuaggccaguguggacugcacaggagauauacccuaugaguggaucucugaguucgagaccagccaggacuacacagagaaaucuugucucaaaaaaaaaauuuuuuuuuuuuaagaaaauaaaguguccaagugugguaguuugaauaagaguggcucccauaggcucaugugcuugaauacuguuccccaguugguagaaauguuuugaaggauuaagagguaugccaguuuugugguuuuaggaggguuuugugguuucaaaagcuagcacugcuggacgugguggugcacgucuuuaaucccagcacucgggaggcagaggcaggcggauuucugaguucuaggccagccuggucuacagagugaguuccaggacagccagggcuauacagagaaacccugucucgaaaaaaucaaaacaaaacaaaacaaacaaaaaaaaagcuagcaccauuccuggaucucucugucucucugucucugucucucucugucucucugucucucugucucucucugucucucucucucucugccuccuacucuuggauaaagauguaaagucucaaccacugccccagugccuggccugcccagcugcugcuggacccaugggccccaacaaacucuuuguucuaggcauugccuugguuagagugucucuucacaauagacauguaacuaagacaaccaagguacucuaguaaaugcucuguaaagaagagaguucgagccccugcgccucgagguguuggucuccaggacuuguuagugagcugacacauuuucauccugaagccagaguuaaacauucaguauauccagagaucagcagagcagccauuuagaauggagcagguaauuguaacaguuugggcucaggccccuugagugacaccugcacguuagucgagacuuacagaauggacagaaacaaugaggagagcuucagaagaacuuacgcucauccugacucaaguccauugcuuuuuggguagaguugaguaaugucucccaagccaucaggcuagcuugcuaaaccaagagguucuaaaccucucuguacuguagggaccauggucagcaguauguccaggauguacuggcugguccguaagaucuaguugcauugguaguaaacaaggccuucuuagcugcuguauccugacagccucucccacaucaacucuuccggucauggagccauuaccauaauuacuucaccuuuggcuggcugugugauuggccaucagugaaacaaaucaguuuagaaccuggacgugcuuuuuaaaaccaucacucuuuuugacacaaauauaccucauuaagaacaggaaugacaguugggcaugguagugcaugccugugauuccaggacuuaggaaguugaaggaagaggacccugaguuugaagccagucugggcuacauagcaaugucuugucucaaggcagacaggaaggcaacagcacaagcaaacaauacaauaggguccugggaaggucggaagcaggaagaaguggcacuugugagugucacugccuuuuggacccuucgauagaaucuguugucauucuggcuuuuuaggucacauucaguuuugauacucaguaaaauuucucgugaucuuuucuggcucuguuuucuugaaugucuugugaguucacaggcuagcuuuuagguuggcuacugcaagacuagcuuaauguucuuuucucagggaacagguaacuaaaauauccaucucuugaagggagccugggcaucuagggagagcacuaaugacagugagaagcaaggaaggagcagcugucacagccaggagguacacaggcacgucugccacuugaacugguauaugcuguuuguuuuaccagaggccgggaggacccagcaauguccugagagaugcgugccugguggcuaauauuuuggaccccagaaucaaacaagaaaucaucaaaaaguuuauuaaacagcaucuaucagaguaucuaguacuuuuucaagaaaaccaagauguaaguauugaccagaugagaucagaugaaacuauuuaauuuuguugaaaaagaaacuaauguugccuuccuccugagcuacccuuuacuaauacaguuaacuauuuguuaacaacuauuaguuaugcacugaacuacagauccccaggcugauuugcagguuaguggcucuucaccauuuucagucacuggauguuuggagaaauuaauaaaagccauagaucuucucccccagaagaguuuaccugugcacaacaccuugcauacaguuuuagggaauacaucgacacuuggugugcaaucauguccccaggugagaacccccguucaaggaaauaaugugguguagacucuuuccaguggcagaaauggaggcugacugucuuuuucucuuggguccuggcuucuacuuacuauuaccacuucugagcacugagugguuuuguuuccuccuuccuaggucgccuggcuggacaaaauugacagacguuaugcuugggugaaacgccagcuuguggacuaugaagagaaguauggccggauguuuccucgggaguggugcaugacggagaggaucucaguagaguuuugccacgugacgagguaaauuucagcugucccauguuuccaggccugacuuaguauccauguguccugcaaauuggacaccguuuccaucucuaccaaaugauuggcaccaccuucacaccaauuacggucuccucuucucuucuccucuugucuccaggucuaacccauugucuagaccuugccucaaacaacuggccugcccucccuuaccagucagauuuguccagagugauugaucaugcccacacuucccuugcuucuggauuguguacaucuccaucaucauuugacuccugacuuccuagauggauagcucccuaaagauagggauagucucucuuggaagacauggcagacacuaaggaaagcauuuguugaauguauuuccauaauagagcguuacuauucugugauuucuuauauuggcaucuggacauccuaggcauuuaaagcccucccauucacccucucugcuguaucugagagucuagucuaggccacaacguuccugauggaagaauaacaccccagcaaaguucaacucagcuauaucuagaacagauaaagccagagucaaacugucuuguuauuuauuugaaacuacaccagacggugugguaaaugguuuucauugcuauuuguuucauucuaacagcauguaauuauauuugucuuuagguuacuacaggagggaaaauaccugugucuaaaacugacuccgcugccuuaggaucacuuauggcaguucucucugucucugucuccccuccuccccuccugugucucucccuuucuuuuucaaccucuguaucccuucccuccuccacccuugaugcuggggauugaacccaaagccuuguacuuacuaggcaaguucucuaccauuuggcuauaucccaucgcaaaucuuccuuacaaacugauagcaaguaccuucaaacuauauacacugugaggcaaaagguuuuuauguaauauugauuuuaauuuaaaaaaauggacuuuuaauguuuauauucguuuuaaguucacaucauaauuaggugucauuacagagauuucgcaugcacgucucaaguucccuucuuaccgacacugcuccucuucccuccccuggcauacuuauugucccugaaccuaccucagcacacucaccaaacuccauggcuuaccuuaggguucacuuuggguggagcuuugcucucauagauauagaucagagauacaguauuuuaaaaaauauguauuuauauuuauguguauggauguuugucugcauguauaucugugccccacaugcaugccaaguuaauuauugguuuagggcuaguugugguugucaacuuccaaaucuuguuggcaaagagagugaacuucuagagaaaucacuuacgaguuucucucagcuucaggugaucacauuugccaggcaggcuugugcaaaaugaggucugagcuagcuggggacuuuacuaaagacagcaagucuugcaggcacugcugccugcuauugucccagcucgggcaaugucgcuauuaagcuucauuguggggauuuuggcgaccauccuacagacacaggcacaggcucuuuguuuggcucugucguuugugugggaagaugaugacagcuuagugcuuacucaguacucaccuguugcuguuaccaaauaaccugcauccugcaacagagcaccuagguacaacacacaggcaaaagcagccaugcaauaaaguugucuuucacugggccuccgaugggcauuucuaggggcugugaucuggaugaagagcuguguauugaguucuccagaagaugaagagcuuuguaauucagcaauucaugacuuuugaaauuauaugagauauauaaauuauauaggaauaaguuucacucuguguuauuagcaagugacugaagauuugaaguuacaggugagguauuaugcuacaugccuccaaucucagcauucaggagacuaaggcaagcagaucucugaguuugaggcccuggucuauauaucaaguuccagggcagcuauggauauauacaauaagaccccgucucaaaacagcaacaacaaugaggaaccacauagagauauaaacaguucuggagagauggcucagaaguuaagagcacugacugcucuucccaagguccugaguucaaauuccagcaaccacaugguggcucacaaccaucuguaaugagauccaaugugucugaagauagcuacaguauacucacauacauaaaauaaauaaauauuuaaaaauauaaacauaguaauaaccacauuaucagauuagcaucuauaauucuucauguguuacuauguguauagucucccucuauguauagauucauucuccauggaugguggaacaauucaugaguuugaaaacaguuuuuauuacaauauauuguuauaauuguuguguuguuguguauacucucuuaccaugccuaauuuauaagucaaacuucuccauagauauauguguggagaaagcauagcauguauagggcuugguacuaccuuggguucaaguaucugaggaaaguuauuagcugugcccccugugggaaggaagacuuuauauuucuauucccuaggcuuuagauugaguugguaauagaccucagaguuugaaaugauccuaaacauuuuuccugaaugaauguaagcuauuuccuuugacauauauuuaauacauaaauacauauauacuuauuuuuauuuuaugauauccuucauguauuauguucuccaugugcaugccugauaccuguggaagucagaagaagcucuccugaaacuggagcuacaaguguuuaugagccacuauguagguguuggcagcugaaccaggucuucuacaagaacagcaaaugcuuugaaccauugagccaucucuccagcccacuuugccauaucuugaaugaaagauguuuauuugacagucucuuucuuuacuuugaagggcagaacuuuccaaaaucaugcgugccagagcuaaggaaauugaagugaaauugcuucuuuuugcgauccagagaacaaccaacuuugagggguuucuugcaaaacgcuucuccgguugcacccugacagauggaacccugguaagaccuuccugacggagcuggguccggguacuggaggcugggguggccaggcuuccuucuugguuucucuguaaagccaucucauccuuuggcuccuggucucaaaugauccuucccccucagcuccagaggagcuaggacccugcguaccugccacugugguuaauuuucucuuaguaaauaagagguuaauuuucucuuuugacaaggaaaaugagccaaauuagugauugcaaaacuccuaacaaaacuugauguggaaucuaagcuugacauuauuguuuguuuauuugcuuguuuuuuaaaugucugccauauguuccacacugaguuaugugcaguuaccuagacucagguacguugauucaucccuguagaagcccccugcuguguucaguugacuuccagagaucacagagauaauaguaaaaacagacguguggcugcuccgauggaggaauaaagauggacuuaagacuggagcacagccaggcagugguggcgcacgccuuuaaucccagcacucgggaggcagaggcagguggauuucugaguucgaggccagccuggucuacagaacgaguuccaggacagccaggacuacacagagaaauccugucucgaaagaaaacaaacauaaaaaaaaccaaaaaaccagaagacuggagcacagcucccugugcagcucucaccccugcaaugcucucagcucccagcuuuccaguccuaaggucccagcgccuugguaggcuccucuccuugcccucauaagaccuaguucagccuagcgggcaggucauucguuacuggacugaagagaggaggcaugguaagcaaggacagcaaaacacugaacagcaacacuccaugaguagaaaauuacugggagacagacuucaggcuguuucuuuagagcagagaacagcagccuagcugggggccuaggccuaggguuccugaaggcuuacagguagaucccucccucuugggagauucuuucccccugucuuagguagcacagggucccuggaccaacccuacugggaggggucugcaccuccugcaaucaggccaguuuauggguagcaggaacauguaaacauccuuuuacauguugaggaugccuggcuguuuauggagguaggaggaaauugcaguugucugaugaacaaggucacugagucuuagggcuccugagcaacacugggcgcuagguuucuguuuccucauggccaucucccuggcuaagcucagauagccauuguaggguauugggaguuauaccaccaccuuaggagcccacuuugcaauguaaaaauuaugacaguucuguuuuaaagcaauaguucaagucccuaucugcucagacucauuuaugaucuuacuaaaagacaacaaugggaaucacaaaauacaacuuucacacuuaacauaagauauauagaaacuggguggugccacuugggagauagaggcaagaggaucaggaguucaaggucauucucaacuacacauuauguuuggagcuacccugggcuacaugagcaaacaaagaaacaguaacacaaaaacuucaccauaaauaaguaaauaaaauauauacacaguccucugcaugcuaacucauuuuuuaaaaaauauuuauuuauuuauuuauuuauguaaguacacuguagcugucuucagacacuccagagggugucagaucuuguuacagaugguugugagccaccauaugguugcugggauuugaacuccagcccuucggaagagcagucgggugcucuuacccacugagccaucucaccagcccaugcuaacucauuuuaaaauuuuauuuuauuuuaguaauagaggaaaaauaggucacaaauggauuaaaguauccuuguuguaguuacuuuuauauuucuguggugaaauaccaugacccaggcaaauuuuagaagcaaggguuacuugggccugugagaaggauggguucauuuccauccuagcagggaaacagggcagcaugaagguaugugucuuaaucaggguuuuauggcagcgaugaaacaccaugaccaaaaagcaaguugggaaggaaagggcuuauuuggcuuacacuuccaguucacuauccuucaauggaagaagucaguacagaaacucaggcaggacuggagccuggaggcaggcgcuaaugcagaggccauggaggggugcugcuuacuagauuguuuccccugguuugcucagcuugcuuucuuauagaacccagaauuaucagcccagggauggucccacucacaaugggcugggccuugucccauugaucacaaacugagaaaauuccuuguagccggaucucauggaggcauuucuucaacugaggcuccuuccucugugaugacacuagcuuauguuguugucacacaaaaccaguacuacauggcaguuagaauaguggcaggcaacucacagcagcagaagcacacugggauggaacaugacuuuugaagccucagagccugcacuuguuccagcuaggccacaucucuaagccuacuaaaacaauaccaccaacagaggaacaaguauucaaaugccaggguucuagggaacaucucaaucaaaccaccauguccuuaaagaaacugcaggggcuggagagauggcucagugguuaagagcacugacuguucuuccaaagguccugaguucaaaucccagcaaccacauggugccucacaaccauccaaaaugagaucugacgcccucuucuggugugucugaggacagcuacaguguaccuagauauaauaauaaauaaaucuuaaaaaaaaagaaaaaggggcugaugagauggcucaguggauaagaacgccaacuacucuuccgaagguccagaguucaaaucccagcaaccacaugguggcucacaaccauccauaacgaaaucugauguccucuucuggaguaccugaggacagcuacaguguacuuacauauaauaaauaaauaaaucuuuuaaaaaaaaaaaagaaaaaaaaaaaagaaaaagaaaggaagaaacugugagucacaaaagggacuagcgccgggcggugguggcacacgccuuuaauccagcacuugggaggcagaggcagguggauuucugaguucgaggcgagccuagucuacaaagugaguuccagaacagccagggcuauacagacaaacccugucuugaaaaaccaaaaaacccaaccaaacaaacacauaaaaaaaaaccaaaagaggcuaguuagcaggaaaaccacugaaagaaauguguauguguaggaaaaccacugaaagaaguguguguguguguguguguguguguguguguauguaugugugugucagcgcuaggacucugucauagagagacuuaccuugcaugcacaaggcccucccuagguucuaacccuccuaguacugcaaacaaauaaacaaacaaaaauaaaacaacacccucccacacauaggugaguauguguccugcugagaagccuguaccuagcagcaucugcgagacccucauguuagcccuaccuuagcccugcuucucagcagagguguaggcagccugcuuucagccugacaggguagagaauuuucagcucugagcaccaagcccacccugauuucugauugcccaggugggguagagcauaagugaacaaggcacagaccucaacaacagauucuggaauaucauucagccacaugcauguuuuaagccauacccuaccucuaucugcaggcucccauuccucaugauuucuguuuuacuguuaggucacuguaggaucacagaacauaugguccucuuguagcugaugacgagggaugccugcaaacccaggucuguccaggacacaaugaucuucuuacuaauccaagaaaucccccaguaaucaaaagugcuaggguuggggcucaggaggacaggacaggaaaagggaguggauauggccaaacuacauguggauacuugagcaagaaugucauuuuucaauccuuccaucacuucuuagaaggaauaugcuguagcuagaaaauaaaauacuagacuaacagggcaaggaagguccauguagacaggccgaggcugcugagcaagucagccaagcagaccaugagaugcuggccugggcucugcuccugugugugaagacagugccuuuugguuguguuuuguuguagagaacauguguagcacuaucuggguggcacuuggcuggucgacagcuacuucugucuggaggggcggagcuggcaugcuuguuucugguugcacaguacuucuucaucuugauuucuguagacuggacuggcuccuggucuggaaccuugucaucugguaguugcuguacucuguagcuaggaacccucuuccccagaccuugucuuucuggucaugugacuuugacauuuucuggcagaacuaguuuguuauucucccuuauaaucuuucaggaguuacuuuuccuaagggaguuucagaucauaaauccuugaccagggagacacacacacacuucccagccuuccuuuaagccguuagugacuuugaugguaaaggacgcaugauacaguuuuaacuggaaaagcuuuaaggauggucuugcuuugucugccaguaccagggcgcccaaguucuagccccauccuuuccuucagcucuuccugcaggagugagcagccagccaguguguuugccucucgccucaacuucugacccugaaggagggauuuaagaaagucuaaggcucacaugccuugaaauuaaaagcaaaugucuauauaugacuuaacuguauccacaugcauuuuuagugacuugaugauuagauugaaggugagcaaauucuauccagccuucugcugaaagcagaguagauugggguuaacuguuucuccgaauuugaauuuuucuuuucuuucuuugucuucuuaaaaaauaagaauccuccuauacaaugcugcuagggccguuuccuuuggcuaguacauagguuguccuucaaaguagaauugucauuuaguuuagaggucauuuuaauguugcccagcuuaaaaaauaacauuauaaaauuacagaaacacuuuucuguuuuguccuguuuuagguuuuggauacaggguccuacagccuaggcaggccuagaacuuggaauguuccugccuccaucuccugggucugguucuguaggcaggcaccacgaugcccagcuugugcuuguuagcugacauuugcacaagagcagagaguuaaaaagucugcacagagcaucucacccuucuggcaccuuaaugccguggaggccgucgggagagaagggcagcuuaggguuucccagggaucuguugugagcaaggaacuagcuuuguuauaccugcggaucucucaucagacuuugaaaauaguaauaauugauuuuuuuaaaguuuuuucuuaugauugugugugaaauauuguguguguaugugugcacgcgcauuugugcacacacauguacaugcacucaugccugguacccaagaucagaagaaauuaucagauuccucaggaacuggguuaaggaugagugugaaccacgaguguggcuggaauccaaccuugguucucuacgagagcaacaagagcucuuauccacuccagccucaccuuccauaccuuccuaaccuccucaaccuuccuaacgccuggaccuucaguacaguuccucauguccuuauaagaguugccuugguccugaugucuguucacaacaguaaaucccuaacuaagagaguauccuaaaggauaguuaaguuaugcauaugucuaaggagaagcuaauacuuagucaagauauaaaauuuggaaauaauaggcaugcgugaagaagcagaaaggaagggauccauuuucccaucagaauugagaacuuuggcugcuuuuauauuuguguaaccgacugcaggucaugucuaaagagagucugcugguuuagccauuuuggagaagaccauggucaauaccuaggcuuucccaacucugccucagacuuacgauauguugguuucucuuuugugcauauauaaaaucuuuuucaaacucacuauguagcagaggcugaccuugaacaccugaucuuccugucucugucucccaagugcugggauuaauuacaugugugcaacuuuauaccuggcuguuaccuacauguuaaacauugauagagaacaaaauauuuuuaaaguaaguucuuuuucuccuuaacuggagcuuucuagucuguuuuugagacucccuuaugaacacacacacaguaugcacauuuuauauuuucuguaaagaaagcaaaaaccuuuauguagaaacauuugugaguaaguauuagucaaacaagaaaauccucuucaagugggcucuguacugaggcucagagaaagagaaguugaaucggacagaugcuuauggguuaguaggggaaagaaaccuguaauaccauccaaugugagauaugaguguguggcagcaagagugggaaggauaguaaacaccaggugugcucagcccccaccccacgcuggugauugucagcuagcgccgcaggcugccuagcaaaguacaagucaggaacugagcuagcgcaguguuuacagugugagaggugcagaguacggggcuuucaucucagaacugaaagcuugcuccuucagggaaagggggaaaauggccuuaaauuucagcgcuccuucuuugauaauguaacauauccagccagggccuccaaagaggacuugugugugcaggcccagauguggaaacauaccugacugaagccagacucuucucacaguaaaugagacagcuuggcuggccuguguguggccccuucuguuuggaaggugcuaggaaucccaugugagccaaucagugggaauuaaguugcuauaugaaaaacuuuaucuucccucuuggacuugagauccacugucaucaucgccaaaagagcagauacucuuaaaauuggaaaucucuuacuuucuuggcaaaugcuucauuucaucuagcagcacagaguuuauagaaugugucauucaaguuacuuaaaauccaaauccaaaccagcacuucucccuggucuacaacagcugcagaguaggaaggagaagugugaccaggauggcugacagcacggcugucacccagagggcugcacucugccagugguugcuguuggcaaaaccuuguuuuccccaugccucgguaaucugagcaguggcgugacuaucugagccaugucuugggcuugguacaagagcauuuuuuucagcaggguggugagugcacaguaguggggcuaggaaggaggaagcauguggugagccacucacaccuguaaacugagcaucacuacuucuguuucuuagagagaucccagagagccgggucagcgcgaagacugucuguguggugcccaaaacaaaugguuuauuuuuuuuuuuuuucagugugcugcuucacuaagugcacacuuauguacaccugugauuacagaggcaggaaggugacaaguucaaggcuaaccuggccaccuacuaagacacagucucagaaggaagagacaaagccuaaggcuuugcugaagucaucgucccuauuaguauaguggaagcgacugcucauuagccucuucccguaugccagaucacauguccagcugcuuguuuuccauuugagaacagagccgaggcuuaagaagcuaggcagauccaguaguagagccuguacuugaaccagauaugucagguccagagccagugcucuccccccaaccccuacuguacagggucuucaucugagugaguguccaaccaaagugugugauccucagcccuuuuuuucccuucccuucccuuuccugguccccuuuucccccaccuccaccccugaccucccccacccccguccaaacucccuuuagaacccaugccuccagcucagucccgaccuccucaguucucucugcaguacuacagcagcuccaugccuucuccugcuccuggugcagucuucucccaaaagcaguggaaggauuuuauuuacguucuuuaaaauuaaauucauccauucauucacuuugugugcaugagugugcaugcaugugugugcuugcuugcuugcuugcuugcuugcuugcuugcuugcuugcuugcuugcuccacacauguagaggucaggacagcuuggaggaaucaguucucuccuuccccuguguggguucuggggauuaaacuugagucguugguguucauggcaaaugccuucaacuguugagacaucuugcuguuagacauuuuuagaaguuauauuagacaaagaacuauuaguccuagauauuugagaggcuagaggaaaucauuugagugcaggaguucaaagcuagccugggcaacauagugagaccuagcuuuguuuuguuuuuaaauccaaauuaguaucuguuacuuguaaaagcccauggugccacuuucuugugaugagaagggaaucuuaccaugccuacaaaaggcacuagccugggcccucugccuuguaccucacacuucugccauccuuccugcagacucuccaagacucaugcuguuagugccuccccuuacuuauauuucuugcucuucccugcuccagccagcugggcccucaguucccucucacagggccucucuuccuugucuauuccuucugcauugccgugcagcgcagggagucuggauggggcagacacauaauuaauguccauugcauggcaagugaaugcuguugcccaagccuagaaagcacucaccccacauuucucacccucaugaagcucaggagcagcucucuauccugucaccagagguucugccccucuacugcaugucuucauagcaguuacuuuuucuucagaucccuuaaggcauguuucugugguugauugaagccucagucuuagcagacugagagcagagcaggucuaucuuacuccaugcuuuucuggguacccaguacauccauuuguuaguggaugaaggaaugugugugcccuaagaaugugcuagggguuucucguccaugauucccuccaugacuucaucagugugcuaacggaagaagggaacucaccgugacuucuagucgagggguccugcuucacgaugcucugcguguccagugcugccuuucauguugucuuuccuuuuucuuuuauccuuucauuugauauguuccucagugggacauagacuccaggaacacucucugucuguuuccuugauucugguuuuguuuguuucuucauuuauccaauaaauaacacauuaugcuuuaaaagugaaguucagcuauauaaaagucaagcuguuauucccaacuuuaguggacuuagcaguagauaaagaacauuuacuauaaaaguucagaucccauuucuuucauggaaugguuuagagcagggcuuuaauuuuagcaaaggggccugcuuuccacauccacgaggcaccaggauacucugagucauagcaacucuacucaggagugugagucccccauucagugaauuuaaggccccuaacuaauuuaauuguucacuuguuuuauguguuucauuuuuugaugcagacucucagguagcccaagcuugccuugaacucacuguguagcugugucuaggcaagaacucuaccacugagcuauauaucucuagcuagggaguuauguuuuguuuugucuuauuuuguuuuauugaaaugauguuuuguauugcccugucugguuucaaacuccuuggcuuaagaaauucuccugccuuacuuuucaaacaaacaaacaacaacaacaacaaaaaaaccaaacugggacuucagguacccaucagcaugccuagccuaacuaauuuaauguuaaaguuuaggucugguaaauucuuuuucacuauccccuucccuuaaaagaugaguauucccacccccucuuaaaaugucagcaauguuguuugcuugcuuguuaguuguuuuuagaaauauucuuaccgaguuccagacuguucuggaacucacuggauagcacagacuggauucugacuagaacaaaccuacagguugagaacugugcucuagaguguuguaauuacaggcaugugucucugugccuggccaaauacuagcaacccuuaaaaagacaaagcuuagagcauaggucucucucucucucucucucucucucucucucucucucucucucucucucacacacacacacacacacacacacacacacacaugauuuacagcagaucaagaagcuagcaugcaaaggaugcagaucuuaaauguuugccugauuguuugaaugcacuguuucuugccaguuuucugcaaaagccauugucuuaauaaugauuaccuuaagcugauauagucaucacaaggcuuucuucguauauagaagccauuuucugacuacaaaauagcacccaagugcuuuagacaauaauuuaguaguuuaaauguguauaaacagaauuaucuuaaagcucauagcagauaccuuaggggguuuugguuucugggagagaagaagauggagagaagagagacaccaugggguaagggauuguaagaacuggcuauauaggcuggccaagccgaguaugaacugcccacguggaacauggcaagucauaauuugagguuauugauagggagguaaaaacuaauagcuuagaggguagauacccagguguggugcugauuaagguuuauuauaaauauaaaaguugugugccuuuuaucugggaacaaaaugaucauaggugggguagaaacccccauuagagauuaagcauuuacuacaacaguuuacauuugguuuuuguuuguaauaccuuuggaugauaccuuggcacuuugcagccauuuacacugucaucuaacuguggccuucuccugguuuuaggaauuauaugaguuuauauuacuggugaugcuacaaugucacaaauacauuuggaaacuccuuuucgacuuagccucuugucuccagggcccaucccuugccacaucaccucaucccagcaucaaucagcccuuuugcuuaucauuuggguuugcugaaacuccuagcacuuaagcauaaaagauguuucugauuauguguguguuggaaugugcaugugugugagugugcaugugugugagugugcagguguguguguacauguggaggccagagaaggauguugauucucuuucuaagccuuaucccuuaucacucacuguuucucagcuggacuagccagcaaguaucugugaucuaccagucucuauguaacccuguaacauaaggguuacaaguacaggcaacuauacccggcuuuauaaacacccuugagggauacacacguggcaaaggcauguaacccacacucggcagaugaagaaggcuucccagaagaagaaaccucucgaaugaaaacuaaaggauaagugagaguuuuagccagaucagaauuggaauaaggguaccugguccacauggugaguucuaagacagccagggcuauguagagagacccugccuuuaaaaaauaaaaauaaaauaaaauaaaaaagaaucgaguaggguagacagcgcaggcucuagaaagcggaagaggacaaugugggugaggauauggucccugugccuccaaccuuguuaugaggacaaauccaaugauccagauguuagaaaacuuggauaaagugaguugccccacaggcucaugcucagaaauaacaccuuucucaugucuuaauagaaaaagcuggaguccccaccaccaucuaccaauccuuuccuggaagaugagacaacaccagagauggaggagcuggcucuggagaaaggagaguuagagcaaguaagucugcugguauuguaguguguaacucaugcucuuccugaaaguggguugcucacuucagguaugaucuggccaggaucacacucagagaucaugacuuacagaaggccucguauaaggacgcaaucagaugacgaagaaccauguuccugcccugauguguugcagaagagccuccacucagcauguagcaccacaugcuugccgcagccugugcacagggcugcccaguuauaguucugucuuguucagcaucuucuggggcugucaggcagcucccuuccucuccuccaguacugugauaaugcaagauacucugagguuagcuaugccauccccgggcuggaagagcccucugcacagagcuagccaauuggaagccaauggggaggccuuggaaacaucagggugaccagcagagccuuuggaguuucuuuucagagcacaccagcacuuuuaauuuccuucagcacuuucuguccagcucaaaauuuccuguuccuucuuccuacagaaugguguuuuuguuucauugcuauuuuaugacaggagaugcuagagcaguaagucagcuguuuccuuucuggauuagagcuccuucucuuucaugcucuacacuuggcugcuagaggguuauuggguggcauuguuucucuccagacaccagccaaagggagguggcugggaggccagcuugaggaaauacagccacacagugugcagcuagcucugcauuccaaguggcaagguugggugaauucugacaggagucagacagcagaauuccuagaagccauuaaaugugucuguuccauugauuaaguaauuguaauaacacagguaccucacauuuaaggcacuuuauaauuucaaaaucuuuacacgcuuucuuucauuucacuuucacuaugugucccucucguuuacaggugaugaaaguacagcucagagaggcucaccagcucgaucacacagggcuauaaguuuggaaguggaggggugggacuagcagccaggucuagcagauggaaacuugaauuccuuuccuagcaccucccccccauacacacuucaugucuuauuaaaaagugaagaccauagaagugaaguuuaugggcaaaaguaaucaggaagaacugagaguugcugugagucuaucccagaaaaguggggcuagcuguagcuuguuuaaagcuguaguauuauuagguagcacagacaaggggauauugcuucugaccccagugcaguucucagagugggagcaaggacucagauuggaggggcuucaauuuuuuugguaaauuccacugggccaccugcuuaguagaaacaugccuugugcagucaugcuuuguauggggccuuccugccuccccaagcuauaagcugccuuugccuugauugauuagggccaugcaguuugagcacucagugcucuguguuagcugguuaccucugggugccauuacacugagucagcagagucccuucauuaccuuugcacccuuuugcuggauaaaauaugacuuugguuuugucuugaaauuuuuuccucuucaugaaagcuugaagugacuguuguaagaccaagaccugcagguuccaaggacagugaugacugauccuggacgagcaggcaggggaaagcaggacucugcagugaugagaauucggggccugugucugcugcucagggcugcucacaggugcuggccuuagguagguuuuaggcucucucagccuccaugcugucauauugugaccuucaugcuguguucuuugaugguccuuggggaguugggagagaaagaaaccaaggucccugcagcuauagcagcuccauucucaguuacuuuguguguggaccuccaggccaagcuuguuuuacaccuaaaguuuuacauguguuuaaauaaaacaaaacaaaacaaaacaaaacaaaacuaauaacaaauucugaucuaggugaugucccugucauuuaaggcuguucuuuauuaguaguaacacucacacagugacuaaugccccccauauguuacucacaccucuggcuugcuagauggacucucagaugccuucccagcagccaguuggcuucuggaguuuuauguacuggaagaacaggagcucuuggggugcagggaagagacuccacagcauuagcagggauccccuucuguuguccuucguuacuugagccgucuccuugcuccagccaguaggcaguuggcucccagggucaaggucacuucuugcucccuguugcaguuugugucuagcugcugagaaaggagugugaacuugaaaaaguagugucuacuucaugagaagaccugagugccuaguugccaagauauucccaguaauauaaaaagaacauuugaaaagggacugagggcacaggaggagagagaagaaaucaggaauuucugguuugcaaauguacccuucuggugauccaagcaguuagauuuaaucuguuuacauuggauaguaauaaaaggaaauggggccagcugcagaccuccuuacugugacaacaguaaccuuuuauuauuccaucaaacuccgggaggaaauagcuuaaacaucugcagcucuuggacagaauucacacacucagcaguccagccugagugcuacugcuaaaugacuuaguguauucuuuaagcugaggaucagcucuucggggagcugccuggugcaaagggagacaccagugugagcugaaauuccagcaccuacucacuaaacaugagcacauucauagagcagccaugggccagggcagcccuguggaaaagugguaagagaaagaaaccugggcagugccucuuguuaucccugccaugcuucaacucauaaaauacaucaacaggaacuaggcacuguggugacaggacuaaugacagacaaggcagagauagaucagucacccaagguagacuuggggcaccugccugucugcugaugcagcuucuguauauucuguggagccucaccauggaaagacccaugaacaucagucuagaugaccuuguuagagcaucacaaagccauguucucccaaguacagaucuguauuuuauacucaccaaggagccuuuagacuugucagacauguguuuaaaaccauauguuguuuuguacacaguuaggaaacuauaagcaaaaccacagauuaagauauuccuaaaaugucuucauauacaagauccagucuuuggaaccacuuguuaauuaaacuauauuuugccaggcaaagcagcauaaacuugcgccccuucuuggaaggcugaggcaggaaaaagugcuucuguacaagccugacuaauugagcucaacccccaggacccaugugaagaugcauuguuggggucagcuggagaagccuguauuagccagcuguuaacuacacugugugcucaggaucucucucucucucucucucucucucucucucucucucucucucucacacacacacacacacacacacacacacacacacacacacacacacacaugggugaacacacauaugcacacacauacuccucacagccuucaugaugggucaucuguguuaaccuagaagaaacagagaccagcuccuggcgcccgugcucugaggugagcagcugugggcuggguaaagcccugugcuuucccagagacucucuccaaguccucuccagggcccagcauuggugggaguuuccacaugguaagauacacaagaucugguggauauuuauccuuaagaaggaccggaguuuugagcagguguaaugggauaucccugguauuucaguacuuaggagguagaagcagaaggauuuucuaggauauagaaugaagcucuuugucuuaaaaaacaaaaacagaaccagaauuuuuaagaaaucuggccuaaaauuuaaaaacaugaaaguuacuagaugugaaagagaaaauuacuggguguauauaaaguuguaaagguccccuucucaccuucccccuuuucuguacccuuggcuagcccagaacucagagcuuuuccuucaucugccuaccaaaugcugggauuaaaagcaugagccaucacacccagcaauauuuaauuuuuauugaaaauuaauuuuuaaauguuuuuuuuuugagauaggaucucucuguguagcccuggcuguuuuagagcuugcucuguagaccaggcuggccuugaacucacagagaucuaccugguauuaaagacaugagccauuaugcccagcuaaaagauguuuuugacugauuaaagugacuuguaaauaaccagaugcuaagaaaguagauagauuucugucuguuacuggggggcagcuuuuccaauuuuuagcaguuauuuuuauuuuaaaaauuuguauuacauuuuguuuguuuagaguggagggaagggaccacauaucuugauauuuguauggaagucagagggcagcuuguggaguuguucucuucuuccacucuguggguccugauauccaauucaaguuggcaaucuugugguaagugcugaaccugcucacuggcccaguacuuuguuuuuugagacagggucucaccauauugccaagguuguucucaggcuaucucucugccucugucucccauauagcucaaauacagauaugugccaccacuccuagcuuuuuuuuuuuaaguuuuaauuuaauuuuuuauuaaacuaauaaaauuuauuuuaaaauauacaacucaguauugauauuuuuuaagucauaaaaauaauuuauaauaguuaaauaccucuuaaauauacaugauaucuuuugaagcuaaaaguaguaugcacucaaccaguuuuuuuuuaaagauuuauuuauuuauuuauuuauuuauuuauuuauuuauuauaugcaaguacacuguagcuuuccucagacacuccagaagagggagucagaucucauuaugggugguugugagccaccaugugguugcugggauuugaacuccugaccuuuggaagagugggugcucuuacccacugagccaucucaccagcccucaaccaguuuuaaaaaucuauuuggaacauuaaacaugauuucaacaugaaguaugaaaaaaaaucuccuaugaaguccucuauaaaaggaaauuguggaaaguuccugauuagacagaaaccauuuuaucugcaagggagaauacucaguguaacuguagcuucauaggauaaauugggcacuguuccuucuguuucuguuuuuuggaauaguuugaggaguauugguauuaggucuucuuugaaggucugauagaacucugcacuaaauacaucugguucugggcuuuuuuugguugggagacuuuuaaugacugcuucuacuucuuuagggguuuugggacuguuuagaugguuuaucugauccugguuuaacuuucguauuugguaucugucuagaaaauuguccauuucauccagauuuuccaguuuuguugaaauaggcuuuuguaguaggaucugaugauuuuuuuaaaauuuccucaguuucuguuguuauaucccccuuuucugauuuuguuaauuuggauacugucucugugucuuagucuggcuaaggguuuaucuaucuuguugguuuucucaaagaaccagcuccuaguuuuguugauucuuuguauaguucuuuuuuuuuuuuuuuucuacuugguugauuucagcuccaaguuugauuauuuccugcaguuuacuccucuuggauguauuugcuucuuuuuguucuagagcuuucaagugugcuguuaagcugguaguucaugcuuucucuccaguuucuuuuuggaggcacucagagcugaguuuuucucuuagcacugcuuucauugugucccauaaguuuggguauguugugucuucauuuucauuaaauucuaaaaagucuuuaauuucuuuauuucuuccuuggccaaguuaucauuaaguaaggcauugcucagcuuccauguguaugugggcuuccuguuguuuuuguugcuauugaagaccagccuuagucuguggugaugugauggaugcaugggauuaugccaaucuucuuguaucuguugaggccuguuuugugacugauuauauggucaauuuuggagaagguauauucuuuugcuuuaggauggaauguuaaauccauuugguccauaauuccuguuaguuucaauguaucuuugcgauucauguuccguccauugaugagaaugggguguugaagucucccacuauuauugugugaggugcaaugugugcuuugagcuuuaguaaaguuucuguuaugaaugugggugcccuugcauuuggaacauagauguucagaauugagaguucaucuugguagauuuuuccuuugaugaguaugaaguguguccuucuguauccuuuuugauaacuuuugguugaaaguugcuuuuauucgauauuagaauggcuacuccagcuuguuucuuggaaccauuugcuugaaaauuguuuuccagccuuuuacucugagguagugucugccauugucacugaggugcguuuccuguaugcagcaaaauguugaguccugauuacauauccagucuguuagucuaugucuuuuuauugggaaauugaguccauugauguuaagagauaguaaggaauagugauuguugguuccugucauuuuugauguuauuuuuauguuuuauuuucuuuuggguucguugaaagauugauuucuugcuuuuucuaguguauagcuuccuuccuuguguugguguuuuccaucuuauccuuuguagggcuggauuuguggaaagauauuguguaaauuugguuuugucauggaauaucuugguuucuccguuuaugguaauugagaguuuugcuggguauaguagccugggcuaguguuuguguucuuuuaggaucuguauaacaucugcccaggaucuucuagcuugcauagucucugguagaagucugguguaauucugauaggucugccuuuuuauaagggaaaaagguuaguugaccuuuuucccuuacugcuuuuaauauucuuuguuuagugcauuugguguuuugacuauuaugugaugggaggaauuucuauucugguccagucuauuuggaguucuguaggccucuuguauguuuaugggcaucucugucuuuagggaaguuuucuucuauaauuuuguugaagauauuuacuggcccuuugggaaucuucacucucuucuauaucuauuauccuuagguuuggucuucucauuguguccuggauguuuugguuuaggggcuuuuuacauuuugcauuuucuuugacuguugugucaauguuuucuaugguaucuucugcaccugagauucucucuucuauuucuuguauucuguugaugaugcuugcaucuaugacuccuaaucucuuuccuagguuuucuaucuccaggguugucuuccuuugugauuucuuuauuguuucuauuuccaucuuuagauccugcaugguuuuguucaguuccuucaccuguuugguuguguuuuccugcaauucuuuaagaguuuuuuuuuuuuguuguuguuguuuccucuuuaggggcuucaagcuguuuaccuguguucuccuguauuucuuuaagggaguuauuuaugcccuucuuaaauuccucuaucaucaucaugaaaugugauuuuaaaucagagucuugcuuuucugguguguugggguauccagggcuugcuguggugggagaacuggguucugaugaugccaaguagccuugguuucuguugcuuauguucuugcccuugcuucucgccaucugguuuucucugguguuagcuggucuugcugucucugaggucuccaggugguucccucugaacagaagugguggucuuaccugugcucacaggcuugucagcacuccugggagacccgcugucucccagagguauuuggguaaggagcgcugugguacgagaucagcuccgggcgcagauggaaacuagaagccuuuccagugguuuucugaguuaguguccgaucaguuuccaggcauucaagauuucuucaacuuuugaaauaaaccuuucccauucugaggcuguggugaagucugugaucucaaacacuuuggacucgggcucacuguucacugccaucuuguggagcagagcgucaauaccucgcuuuuuuuuagugugcauuaagauagaaguaguuuaagagaguagacuucuauaaaauauucuuaccuguuaacaucaucauauucauaaucauaauggaggugaaaggaagaggguguacuuacagcuuugaugacaguauuaauuuacagauauaugcuuaucucugaauuuagugcguuguacauuaugaacagaggaagaggaagguggggagagagagagacagagagagagaaagagagacagagagacagagacacacagagagagacagagacacagagaaagaauguguguguguguuuaacauaccaguggagcaacaucuugagccccuuuuuuguuuguuguuguuguuuugguuuuuuuguuuguuuguuugcuuuuuugagacaguauguuguucuguagcccaggcuggcuucagacuucagcuccugcuguaguggagugcugagguagcagaaacauaccacugugcucaguucaagcuuuuauuccucacuaagcugauuaauggagugugguagagugcuuacuaguguacaagaccuuggguuugaucuccagagcuacaaagagaggaagggaagucuguaagcagcaguucuagucagcaaguauguuacaggcaugguuuguauucaguuugaacucucuggaccuuugguauagagucuuugcugaugacaguagucagauuaacaguuuuuuaaggacuagaaaguaacagagagauucuuauuuuuagaugauuggaaaggaauuaggaagagaauacaauuuuuaaaugguugcugccaaguaaccugcuuccuagcaauuuuuaaguaucaguguagggacaagacagucuccccaccaggcuuucuagacaggacacccucgugcugaaggacugcaaguggugaagcuagaaaguagaaaacaagguggcaaccccucuguuggccucccccuccucucuuucuuacauuauuuguuaaucaaagucugaaacugggaccauugcaggaaggaacaagccugccugugugccugugggauugcugcaagagcucggccucauuuccugggcugugcgguggcagcaguaagauuccgugaaggaguauuguaagggcacggcagaaggcacugagugucaggaugcauagcaacagugguaacuccaguguuaaguccagccagauuucaacuuuaaagcguccacugaggaugagcuuccacaucagagcagccguagaucuucacauauccaagacacagcaaguccaaaauacggacaaacuggcaguggcucacuggaucaauaaugcuggagugacgcaguguccacuguuuuuaucugugagauaagaacuucgguguuuccuuugaaauugcuuaaaaucuugccgagguugcucacacauacagcucagacucguucacauucuccuuccucucuuuccagccgaagaagcccaaggccccggacaacccguuccacggcaucguuuccaaguguuuugagccucaucucuacguguacauugagucccaggacaagugagugacaacauucugccuuuguuucuagccucugaucauguugguuccuacacagggacaacuccucccagagucacuaagaauaccauuguaucuucuguauauaaccuuuuauuuugcccaugguugguuuguuuguuuguuuguuuguuuguuuguuuguuuguuuguuuguuugagguaggauauguagcccuggcugacuuuaaauucauagagaucugccugccuuugccucccaagugcugggguuaaaggcauggccacuacacuggcaccuuuuccucacaaaucugugcugcugaguuuggcuguguaagaguccaugugggucggaacaccucccaccccuaccucuaugugggccccaaccacaugacuccccccacaaagugucagacacccagacauuguaagaaagccuacucccugaaguauauacuuucaauuauaauuuggcuuuucauugugaaguaauuuuuccuuucauaaaaguuuuaaaacagcacaaaauuuuccacuagcuuuccugaggcugugaaugccuuaauguaaacauaccuaucaaauccaaagaaggguugauccugcuucuggucugggaucccauaaccaugcgcuucgguguggggucucuguagccuccuuuagucccaacuacgccuugacucuccuuacucuuucugaccuuggcacucuuagagggcugaccagauguuucagaugcuuugugaaaugccauccauuuccauuugccggauucugggccucuccuacccacucccccuccccuccccucccaccccagcccccugccagacccucucuuuugaaacaguuucuaauguugcccagacugcucucagcuccugggaucaagugauccuccuaccucagcuuucugagcagcuggagcuccacacacauugauucauguauuuauugucuuucuuaaacccaaguuaggcucugccacuacagcacacacucuaacccauggcuuagggaguggaggcaggcaauuucaagcucggagccagccugagcugcaugugagacucugcucccaaacaacaaaauccagguuauauacuuuugguaaguaaaaaccauagcagugccuucucaggcuacuggugucggcucugucugcuaaggugaagcccugccagccuuuuccacugucaaguuacagggcuuuuucuuuauauuaagcgucuugucucuaaaaaccaaaauaaauaaauaaauaaauaaauaaauaaauaaauaugaugaugaugaugaugauggugaugaugaugaugaugaugauaauagaagaauaauguuuuuaggggcaugccauguccacccacuuggucuuauaggcaauagucaaaaacucuuaccuuuucuucuacccccaaauacaaaccgugugaaacaccuuccaguuaacacaagucagcacacaccaagaaaagcaaaguugcuuugagaagacugcucccaguguccagcaggcucacagaagacacuaguaaccaaugcugcuuuguucuuugaaagcacccugacaccugcccacccucgugugugugcaugugugugugagcacauacaccugucucuugguguuauuucucaguagaugucaccucaggauuuuuuuuaagauuuauuuauuuuuuauuuauaugauuacacugcagcuaucuucagauacacacuagaagagggcauuggaucccauuacaaaugguugugagccaccauguaguugcuggaaauugaacucagaaccucuggaagagcagucagugcucuuaaccauugagccaccucuccagccugucaccucaguuuuuugaggaaaggucugucauacugaccugggacuuaaugaguagacuacacuggcuuggcagugagccccggggguccucuucucucucuugggcugggauuguaaguguacaucaccacaccuggauuuucuuaauguagaguauagggaccaaacucagguccucacacuuaugcggcaaguacuuuaucaacagaaccaucuccccagccgucaacccagauccuuagaauccuuauuucagaaagaccugaaagcuacuuggccuagaccuuccugaccuaaagaguuauuuuucucuuucacaauguuguuguccacuuuuuucauggacuugacucaucaaagucugaagguugcucucacgaugcuuugggcaaagagccaggccuccuuccccgggcccucucggccuaugaaagaugcugcacuggcugcuuggcuggcauuucccucguaggauguuuccaagcucugagggagcucugggggagcagcaggcccccaggacucacaugggagcacagagcaggggcagaagcagaagagaguugaagaacuccaacuccucuccugguagagcagagucggucuugauuccuauaaugguuauuaaccuucgacaaggcauagauccuuucaagacuccuagagguaugggccuauaaucccagcuccuaggggaguggggaguggagugauugcauguuccaggccugccugggcuacagagugagaucacauccagccugggcaacuuagugagaccuugccucaaaaauacacuguaaaaggaggguuguggauauagcucaguggaguacuugccuaguguguauaaggaucaauccccaguaacauaaauaacuaaaaaguaaauaguaaacuauagaccuuuagcaaaaaaaaaaaauaguuauacacacauaguaauuuugagcacgauuucaggggacuuuaggaagccacuuuuuccuuuggucagagaacgcugagcugagaaagagcucagacuuaugggugcagucacugcucucauaguuccacucagaaucugcaagggaggugaacagaccucucaccagcacaggagacagaggaggggccugcauccaggaggaccugaauuucaguuagaguucuacacucacuagccugaagccuucagcaugccacuuaaccccuucuaggcuguuauguccugucuguaucaagguucaucagcccaucucauaggcuuuguaauuugagugauacaccucgacaaguggcuccuugguccacaguggauggugugcaggggcugcucugcccucucaggaugccugugugggaaggucaccucauugggacugcagacuucauauggagccaggcguggagucugugcucucuucucagcauucuuugugcccaggcgacauuuuggcagaaccugucccagcaaauagucacacagcagaaggcccacaagccaguauauaggaaagaagcaaaucccugccaaccaccugugugacaagcugggcuaagcugcccuuaccugcauaagugcuuuccccguuuuuguguugcaccuucugcucuggagcugguagugacucccccggcuaacuuguggggggauuucuacaucagcacugucuucauucuaucccgugguuuuccuugucaggaaguuguugugacucaacuucugcuuacucuccugaguucccuaaaguaacuuguuaccauuccuacccccuucuuagcuuugucacacccacagccuaguuuuguuuaaaaaaauaaauuuguacuuucagaacaguuauaagaaagccuacagaagucuuuaccccuuccccggcuucucugucacuuuggccuuucccaccuuucuucuacacacacccauguguuuaugcacauacacuguuucagccauuugaacucucaagucugaaauaagacuguguauguccuaaaaucaaggaccugggcuggaaagauggcucaacacaacagcucuugccaaggacccgaguucagcucccagcacccucaucagaugcucacaaccaccugaacccagcuccagggaucugacaaccucuucuggcccugugggcacacauacauucauauauguggacagacccacgugugugcauauaaaugaaaaacagagguuaggaagguagaucaguggcaguguccaccuaguaucuacagggcccuggguuucagucucggcacuacuucaaacaaaccagcaaacaaaccuaacaauaaacuucuguuggguucgguggguaagagcacuauacacuuccagagaacugaugcugggcucccagcacccagcaugugcgcgcgcgcgcgcgcacacacacacacacacacacacacacacaaacacacaaaaauagugaucuuuuuaaaauaaauaaaaguuuaaaaagacccagucuacauaacuauaauguaaucuucaagaucacuuugaucucuuauuaccaguuaaauccagaggucauguugaauuuuaccaguuguguuuaucuaauucauuaauuuauuuauuuugaggcaagaugucauguauggcaggcuguccuaaaacuuguuacauagcugaagauggcuugaaauuuguguguguguguguguguauguguguucaugguaagagugugagugcacauguguguggaggcuagagaauacccuuaaguauucaauuuacuuuauauuagaaucaauguauaccuuuaggaaaguuaucaaaacucgcacaugaugugugugcagugggaggugcuugugaucuaaugcucaguugcugaggcaggagagccuuaaauuccaggucggucugggcuacagagcaaaacccuguugugaagcccaaacaacaaagcuggacaugaaagucagcacggugcugcuaccggccucaguugucccacuauugcccuuuucucucuagaacugaucauuuuaguguucaggcuaccugugauguguccaggaggaccucuugagcuggcucuucauccuuuuuccaugccccuaucauuuccugagcacucuccuuucuuucuggcacaccaggcuuaucuugugcauuauguccagcccuagggucaugcuugcuuccaggcuccccauuuccucuguagcgagugaccucagauaccaggcucuggugugagagugcugagugugcugagugccauuguuccugggcacucagcugagagagcugagaaacgugugcccacaugaguguagaugcauccacacacaggcugucuucauacuaccuggaccuuaaagccuguggguucaugucaagaccucuagucuaaccuagcaccacaggaguucccaagcugauuacugccucuauaacacaauagcaagaugcacggcuccucgcacucucgauacauuuacuugcuuccuccauuuguccauauguagcccaucccccagucucuuccuaggcccaccccagaggcaaguccauaccuccagcccaagagaagugagaagggugcacguuagugggugcagcucugagugcaugcaugcugaaucugugugggacucuugggccaccuccucccagugccgcugcuacauugcuuuccagucuacuuauuauuucugaaugcugacuucagauccauccacacguaucaugcugagcccagucugcaaugagacgauugcuucuucuccuuuguucaucguucccuguaauacucuuuacuccacauucaucuuuaacuuaaucagcagaacuccuaacaguauguuaugugaaaccugcaaaugcuuacacaguucuugggcacaaagcucaagcugcagagaagagagagaaggaaaccacauguccaugagguuucucucagcgggggagucaggaacagcaguguggcauguaucugcuuaguacucuagagaccugaggucagugccagugacucugugaccuugcgcaaagguacuucaaguugccaaccuugguuucuuccccuuuauagcuauugggaggaauaaaugacaucauauuuuauaacacaucuauaagcuaaugggagagaaagaccaaaaagaaaacagggaaaaaagaauguguuguaugauauuaaaaauaugaggagcuggagaaauggcucagcagucaagagcacugacuacucccagagaaucuggguuuaauguccagcacccgcauggggccucacaacagucugcaacuccaaucccaggggauacaccacccucugcuggcuuucuuggguacugcgcguacauauugcauaggcaaauaugcaggcaaacauucauucacauaaaauaaauaaaaucucaaaaaagguaaaggucugaagggauagcagugggaaucaaaagggucucacugccucacucaaggccaggggcuuucacuuugcaucucagccacagccacacucucuccuucacaccugaucccucuuugguuuuggcuucugagauaggaucucauguagcagacuugcuucaccucauuaugcagcuaagcaucuccugcuccuacuggcucuaccucucacuucuagcuacauccuuuuguucucucccugauucugcagcaggcuuucucugcagcccauuccgcaaacagcauuuugucacucccuugaacugugacuauucuaaggcugcagggauucucaguagcccacagcccuugcccaggacuugagcauuuguaaacccuuacuugcucacacuugcucucagguggaaaagacucccuguguuccaggcugcagauuguugggccacgcagcccuuucuccauuaauccuacacgaagaucuugucaaacgucugcugucagugauaaccuucuuuaaguuaaauguauuucaaucuuaccuuacagcccucaagccuugcguacaggaagugagugcuugauacuuagucggacuggcccaguacuucauaagcaaugaaccucagagguuccacuggggcaucuggaugcaugcuggugcagggugcaagagggcacaggcaagcuuccucacuaggcuucuuucucaucugcaauagagaacaaugccaaaaguaacuugguggacauugcacaaaaauauagaucucuagaggguguuuuugguaaacagugcuccaugcuuuaugaucaggugggcucugaaauaggaaguggguaaagacaguuggggugguaggaagagauagguggauagauaaagucacugcagagugucaucuguguggagaugaaacccucagcagacuccagugcauucucugccuugcauuucuccucuccuacuccuucuccucuucuuccucuuccucuucuuccuucucuucuuccucuuccuccuccucauucuucacugugccggccccuaucccccucuacuucugcacuuuauucccauccuuaggaacaaaauguggaagauggucaucuaaacauacuuuggguacuaacguaaaggauagccugacacacuagccagggcagugggcugagggagcaugaacaaauaccgccaccccaggggagacccacuagugcacacagagaccuuaacacuguaaaucagcugugucuauggcagauacuugcuggagugcuguucccaguacuguggaauuacagcauaaaucagggaaugggcccuguugauucacaucacccacugugcaccaggauagggaaagcuugaccuguuacacaguacagaaaaauauuuacucaagugcuaaaaccaggugcugugguacaugcauguaauuccagcaguggagaaacugaggcaggauaucacaaguuucaggccaguuugggcaacauaguaaaacccugccuggaaaaaaaaaauaguaagaaccagguguauagcacauacuauaccccagcacucaggaggcuaauacaagaggagagucauaaguucaaagccagucucaaaacagaugaacaaaccaaaaccaaaucaugugguagugaguggcaggugauggcaguuccagcugagggagcagguguugguuugagugugcaauggggucauggccuagagagcuagauggaaggugcuuuggccaggaggugacaagugaaggcccagcaguggggccacagaggugacuggccugggugccuucuccgcauaagagcugugaggauccaugggaaaguagggcaagaagaguuugugcagagugggggugguggccaaggcacuugcaaaggucauccaaagaggccugucuccacaggcagagaccuagcucuguuaagcagccacaucuggaugucauaaaccgaguaacaaaagcacuggaguaaaaugucaauuguuuccuauuccugcuaaucgaugcugugugugguucuugccuuuuucuccuuauuguauaaauauauuuuuaaaacacagcuggauucuuauagccuuagccagcaagcuaaaaagauaccacaugucaagaggggccucccauuguccucacaacacagcuguacagaggacaguaguuaaagcccugcuagauuccagcuccugaugacuuggagugacuagggcaacuugagagauguuugauugggaaaguggagacagaucccagccacccuccucaucaugaccaggcaagccacuuuucccaggcaccacuuauaucccaagauuuuuuuuuuuuuuuacaucuuuaauucugaaaguucuacagaaaaacuauucaucuuaaagaaggaaagcauucuuucuuuaaagccauccauccucugacacauuuagguucaugaugucuacaucuuuguugccaucagagccuuuuuguaggcuggugaaaagcaugaggcugggguccaggcuguggggguuugcacccugcuugucuuggacaagguguuuuucugugccuggcuuuuggagacggggcauaguaaaguagguaccuccgaggguuauugcuaagaguuagcauucugugacaugauuauaaaguacagcugugacuccugggccaucauaagugucuaggaaauggucaccaccuuuagaauuugggacuuugguuuguggaaaggggagcuggugcuuggcauuccggggugcaugcuucuguggcagguucuccagccaguucugccacccaguuuuaugacagaguuuuaggugucaguuuucucaccuucugaaggagcagcagugcucugucucccucaccggggucuggggucagacauagugaugagaugccuggagcaaagcaaucuacaaaugccagacuucauuacugccaucuuuuuuuuuuuuuuuuuuuuuuuuuuuuuuuuuuugguuuuucaagacaggguuucucuguguagcucuggcuguccaggaacucacuuuguagacccagcuggccucgaacucagaaaucugccugccucugccucccaagugcugggauuaaaggcgugcgccacuaccgccuggcuacugccauuuuuuuaagcagggagaugagugccacauggauaaaaugggcccacuuguaaauuugggucgcaccagggaagagcacucaugggaacagcuucgguccuugcagacagcacuccugccugaucucuccaagugaaacaauauuucugcuuuuccagaaaccucagcgagcugauagaccgguuuguggcagauuucaaagcccagggcccacccaagcccaacacugacgaagggggugcugugcuccccagcugcgcugaccucuuugucuacuacaagaagugcauggugcagugcucacagcucagcacaggcgagcccaugaucgcccugacuaccaucuuccagaaguaccuccgagaauacgccuggaaaauccucucuggcaaccugccuaagugaguccuguucuccucacacucagcggggaauugaggcuccugauaucccuaaauaugggagucucaaaggaaagccacucagguuguuuacugaacugcuaagaaugucgaagaagaaaacacuccucccaggcucucaaggaccugacccacuguuggugaugucuucuauaauggcauccacagcugaccacgacugucagcaggcauguucccccagacaccaguguaggucacaguacaucacuaagcugggccuuuauguauauguauaccguacacauggugucagcacagaaaaaaagaaguuaguuacucaguagcagaggcaauguggcuccagccuguugaugcccgauagacaagcuuucuuccucugacugucuuccagccucugaugcugugaccacagcccuaaguguagaugugggugaauuggggcaggggagaacgcugaguggguacagugucuccugcacaagcgugaggagccaaguucagauccccagcaccacacaaaaggcugggcucgacaacauucgccuguaacagcagcagcaggagggcagaggcaagaagaccccagggccucaauggagcuagucaggccaacucuagcaagcucugggcuuagugagagacuuaucuccaaaaccagauggagaaagacagaggaggacgccaucaucaacucugcucucuacuuguguguucaugggcgcaugugugcacuguuaggccgucuuacuccaugugugcacuuaugagcuccacauguaugcaccuuaacuaagaaagauuaaggagaagcagauucugugccacagauggcccaagugggaucuucaccucggggaaucccaagccaaggcacuaggucagcuggucuccuuggugagcauggggucaccccaggugaggacugcuccccgcucucuaggcguugugucuuccuguuccugugggugagauggccugaacagaugacagucaagguaaggucaggagcaaaggcccccauuguguguugauuuauuuguacuguagccagccuuuccucugcuuucuucccugucauaaaauaugcagcuucaggaagcaaguuagcagcugcagccugacuaguuccuguccuuuuuuucagaaccagcagcagcaguggggggcugaccaucagcagccuccucaaagagaaggagggcucagaaguggccagguucacucuggaggagcugugucucaucugcagcauccugagcacagccgaguauugucuggcuaccacccagcaggugagcacccauccaagcucgccucucucccagagcucucucccacgccuggagugggaccugugagcuccacuaaggucuccugccaccuugggcaggccgcuuagccucucaggagcaaacucaccuuauagucagagacugcccaggcagccaucuuacaggggagaaacggccagcuuucacccacauguaagcuacaaaacaggcaugaccucuuaaaaguaggucaguagcacaguguccuucaugggaaaagcaucaauaaacugacuucuggguaccaagcagccuuuccugccauuuuguagcauccucuguccaccauaacaaacaaccauuguuugaaguguuaacugugaagcagaaagggugaggccucugauggagccaauggaaggcaauucaacaaacuagcuuugcagaaggugagccagaggaacuugccacucagcccuccacgggguuauagacuucuuuuccccauuuggccugggaucccccugaagcaaccugagagaauccugcucucccugauguuaauguguauuuccuaagcaucuaagaagucagcuacaaggggcaguucagacgugacagcuuggcauuccuaugugccagaacaugaacacaggaaguguccagcauacuccuugagggucagccagcugggcccagaggccaaggccaaggcaguagcauacucuacuuggggguguggucacauauacaaggaaugacucacagaccacuuuggccuaggagacagagacagagagagacagagauguucaaaccccucaugaggaaaauagauguuuagaguauaugaaugaauaagacacauaaaauaaugucacuaauucagagauuuagacagggucucaggguauagauaggcuggccucaaaaacucagagauugcccucugccuccaagugcugggauuaaaggugugcuccaacccccacccuacccccaccacuauuccuccaccaccaccacccagcucuuaacacagaaucuuagacaucaagugaggaaagugacacaccgcaccucugcauuuagaggaaacucagaaguucagggucuucuucagcuacauagagcgcuuaaggccagccuggacuagagacccugucuuaaaacauaauaggggcuggagacaugcucagcaguuaagagcacuaguugcucuuccagaggacccagguuggauucucagcaucuacauugcagcuuacaacugucuguaacuccauuucuaagagauugguugccuuuucugguccacaggcaccaggcacucuuguggcacacauagauacaugcaagcaaaauagucauauacauaaaauaauaaaauaguuuuuaaaaagugaacuugagaugcuacaucauguaacaagugaucaauucaagacagagucgccacagacucaggaauugcaguggauucaacugugcccucaaagcuaaguccugcucagccguggguauuggaguauuugggaauuaggccuuuuaggcaagaaaaaaacuuuuuaaagauuuauuuauuuauuuuauauuuaugaguacacuauagcugucuucagacacaccagaagagggcauuggaugccaugacagaucguuaugaaccaccaugaggauacugggaauugaacucaggaccucuggaagagcaguuaguguucuuaacugcugagccaucucuccagccccuaggcaagaaaauuuuacaaugaauccaaacaccauugacaaauaagaguaaaaguugggugguauauaucuugauuuucagacuuacuauagggcuagggcauucagugguagaauacucaccuagcgugugugccgcccuggcuucagaccacccaagaccucucacagggcuagaguaaggaagacggugcugcuguuggcaagagcaccuccucuuuccaagcaguugcugcucuccaucuugcuaacauguccucccaaacacuuugcauuuuucuuuuuaagaaaaauagucucaaauucuacauguuauucuacaacaaaguggccuuauuuuguucauaauuagaucauagacaucuuccuuuuuucuuucucauucuaucuaucuaucuaucuaucuaucuaucuaucuaucuaucugucuaucugucugucuguuucuaucuaucucugucucucuaagacaaauucuccuuuugggggugaggugucgagacagaguuucucuguauagcagaaccacagauguccuggauguccuggacuugguuuguaaaccaggcuggccucaaacucacagauacccaccugccucugccuccccagugcugggauuaaaagcuugugucaccauauccagcugacaaauucuuguuggcccaggcuagauuacagcaguuuucacugucucugccucuagauagcugggauuccaauuccaggccagcacacuuggcugucucagacaucuuuugauaccagugcuaccucagcuuucucaacccguuuugagucucucguuaauucugucaucccuucaagggagcuuuacuauacacuucuaugugcugcuucagcugguguugugcagaggagacaggcaucuuccugucaggagacuuagagcagauggaaaacaaauagcaagcaagcaggcgaggguuucccugccacucuguaguaagggugggagaagaaacaaacaccaagagaggaguugggagggcuaggaaauggagucaggagggggagcagggacauuguagagggaggaaauauggagaccaagacccugcaauuguaaaugccagaggcaaggcaaagauagcaagaugggaccagagagauagaugacaagagccaugccaugcuuaaaguuaggauguaucuucagcaaaguagcagaggccccuggagcaugugaacacaggucuguggaacacugugccacccucccgcauagguguccagguuuucaguaauaugaacccuucugggaagaacuuuacaaaugcggagucugaccuauugaguucucuaaacagccccucaccccuuaguaguggcagaauuaaaucuuccaaaaguccuugcauggcuccaucccucuaagagcacuuuaaaucuuaaugcaaagcacucaccuucuuagagugagagugacucucuuaagagugcuagauuuauccauccccagggcauuuuuagguacgcacagaucccgaccauccuauaucucuccaucguauaucacuccggaggaugugaaugcuccugcccuaagcugaccaaaguaaagauguauuucugauucaucacugagacaucugguaccuuggcaaacaucuuggcugauuuuacugucacucucauuaaaaguucccaacacugguuggggaggcuacauaucacaggguaagcagggaaacuauacguagauacagcuuaagagaaggagggaucagaagugucccuccuucauagauacggcuuaagggaggagagguuuuugcaguccacccacgcugggaaagagcaauggugcuccuggcugugcagacaugagaagagacuccucuggcuauuggccaggaggcaggguucuccuguaaccuucaaaugcucucacccacuuuugauaugcagucucuaacucauaaaggcucuacggccuucaaaauagcgccaccacuagggaccaaauacucaaaucaugagccuguagagaacaaaccaugcgagcuauugguguguucucagaagugagcccagaguggugccaaaggagcugggcucuagggagcuuauuugacccuaucaccugcuguggcuacuguaguccucaccuaugaagucaggguaacaggacuucccucacauccugugggaauuaagugucccaugucaugccuagaacugucugggucgucacuuugugagccucaguaguauggaacaccuuuggguaaucauuaaacacccuucugcuucugcccuuuucuaacagcuagaagaaaaacucaaagaaaaaguugaugugagccugacugaacgaauuaaucucacaggagaaauggacacauucagcacguacguaccuuccaggcacuugcugcaggucagccuuccuucuucacagacgccgugugcuuuagucucuacuaagagaggucccagggcguucaugccccaucagcugugagaagagugcccccuuaccccuccuccuccuccucugccucugccuccuuuuccucuucuuccucuuucuuuucuuccuccuccuucuuuuccuacucuuucuccucuuucucuuucugacuuaagcaaguuuuuugaauacagaugcuuucugagaagaacucaaaaagagaucuggaauuagcagcuaugggaguagccauagaaguuugggcucuuacugggugagacacacccaaauaaaacaggacaugaaaagccagcugcucuuccauuauuagugauuaaaacauaaaauuucaugaagaaauaaaauuuuaaaauuuugcacacauuucaaaaacaccuacagggggcaugucuagcaucccaccacuuuuuggagcaauaaccacagcaauuuguuucuuugcagugucaucuccagcagcauccagcuguugguucaagaucuggaugcagccugugacccugcccugauugccaugagcaaggugagguuuuaggagcuagccuccuaccagugauugacaugccuucccccagccuuuuauguuauguucugacccuacuuugugucagcugagagggcccuagggagacaucacacacacacacacccuagaguuccugcuaggcucaccuggcaccuaugguuguuacugguccuuuuguggggguaggggugagucugaagaagauugguucuugggucagcaucuggcuccugcugaaaccugccaguguucuugccaggugagcacuuuguugagcucuacagcaauaacuacagacuccugcccacugagagguucuggcucuuccugagcuuuggugucagugcuaaauacuuggaugagccugugcucucagguuuucacguacccuuagcccucagcccucuauggcccuuuugacaccauaugcugcucuuugggauuuuauaugcgugcucuuucuuccucaaacauaaauuccugaggaauguggugagucacgccugugaucucaggauuucgaagcugaggcagaagauuucaaguucaaggccagcuugugcuacacaggaaggcccugucucaaaagagaacaaaaguauuccuuaagugucuagaccauauugaagacuuuauguuuauugauugaauagaaaguaggcaauucuuuguugacuuuuaagcccaacaaagccuuguaaagcagggauuaagaaaccauagccugcagccaaauguggcccaccacuuguuccucuaagucuuagggaaacguaguagcuguguucauucacuuaagcacugucuauggcuguugcuggaacuguagaaacuagugcuuauagcagagaccuuauggcccacaaagcuaagacaucgucuaguugacccuguccagauaaagcuugccaauaccuaucuagucaaggacucucggaauauucuucugaguuuuggaagaauaaccugucugggagaaacuaggcagaauuuaugacagagggcagugggcagaaccaugacgcuggauaggaaggaagaccuaaaguuuucugguuuuccuuuugagagcacugcacagaugcucucaaaaccugugcagacccaucucucugugugaaauucaucugacuggaggccucucagagcugugcaaguggacagcaguugagugccuaguggugccagucaagcacucagaaagcacagcuucccccgucuugacaagaggagcaccacgccucaggaaguagacauuuggucugaguuuguuuuuauaauagauuauaacuauuuaacaaaaauaggauuaaaaccaaagcuuuggcuuuggagucuaaggggugaaguaggaaguugagaagcagcugcuauucuuaagacggauccugugcccagccgggguccccagccccaggccgugggcagccaguuugaggcugcucuguggaguggagcugugaggauccguguccuaggcucugguuuauucccucacugcuggcaaaccuucugugcauccugaguaugauccauuccagcugccgucuccugaaugcccugccacacugcagccuggagcacagcugccaucuccugaacugcccugccacauugcagccuggagugcagcugccaaaagauuuucacacugaccgaaggaagaguggaaccuuuuuuuucuuucucuuuuucuguaaaauaacacguggaguggguuuaacacuccagguguugcuuauaugaacugucaguucauuaggcagacuucucucgaguuccucuuucuccccagccauuucuccccagaugcaccccagcaaaugucaaccauaccuccagagucucauguuuauaucauaggauaaccauaggcuugggaacauagcgguuggaaggccauuccuguuugucugagucuucuggagcucuagcaaaaugagauccaugugacuaaaguaaacauggcagugucaccgacugacucagcaugagcccugcauucagcuucauggaguuucuucgaggauuuuuuuuuucaaaccuugugauggugauuauuucugucuuugauuccaucauuguuugcugcuggauaacuaguccauccuggauucugucuagcaaugcuggggguugcaagccugggaaaggcaucggcauuguccccaggugcuccgucuacuagguggaggcagaugugagcagagugugcagaugugugguaugagcaaggggaaacugggaccauaggagaaaagcagacuccuacagucagcagcaucuaagaaaccagaggcagauaggacaugguccaguucucuugaaggaauuugugaugaguaugcuguucaaacaggacugcaggaagcugcaguuuucaaaguuaguaaagucaguuugucagaaucgccaaucucuuucacugccuugggaaguuacagagaggucuggacucgggcaaggcugucuucauguucgugcugugcugggagaaaacucaaaauaaccaauaaaauaaauagauguauuucaucaauagugagggcaguggggaguuggcuuccggcagagcccagggcugguucugaggugagggaaggaggcuccuugacaagguggauagagcccagcgacuggucacaucauuguccugggaggccaaagcucuggaauguccucaguuagcauauaaggaugaauaauuaauagguugccauauuuccugucaauuccuugggcaccuugucugugcgguuuguacugcucccgugcaaacacccucuaccucagcuugaagccaguucaacuuaacuaaguaugcacugcuuucuggugguggccagcccucccucgcucugaccuuucuacuuagaauucuccuugaacugcugucuacccagaaagcacagccuuuucaagagugagcucugagcucuaucuccccuuuaaaacacugagcuuuaauuccugucuuaguuaggguuucuauugcuaugauaaagcaccaugacugaaagcaacuuguggaggaaaaggcuuagaucuuaggucuuccucugucacugaggggagucaggcagaaaccuggauucaagucgacaagcuagccaaagcaaaucccagagcacaugucaccccuuaaaguguccaaacuaagagaauuuaauaaacauaugagaccacagggccaccaauacugucucauuccaggguauccuuaugacccuggaaggaagcccccaaccucucagcggcugucccaacaugcccuguucccugacagcuauuagucuacuuccugucuguauagauuaccuauccugcuggacugccuacacuuuacaguauuuucagaguucauucaugguauaccaugugucaguauugcacauuccugauuucucuguguuuuugugaguuuuguuuguuuguuuuuguuuucaaauaggguuuuaccauaguaagaugucuuggaugcuggcuguccuggaacuuacuauguaaaccaggcuacucucaaacacacaagagaucaccugccucugccuaccaaguacuaugauuaaagaugugcaccgccacaccgagauacauuccauuuuuagaacaaugcuaggaguuggauccaggaccuugcuaauaacgagcaugugcuguaccaucaaacuacccacccagccucuaguccacuccuucaauggcugagugauaaucccuuguuuccagcuugucagaacagugcugugaacaucugugugaguauaccuucucaguuuucuucggugcacaccuaggagaggaacugcugggucucaugggaacuucacuguacaguuccagguacugucucaugguuuuccauaucuaccauuugacauucccauuagcaccguagaagucuaaacuuuccacauguguggccauccguucagguaugagggucugucuccucucggcuucacuccuagucucuggugacuaagaguaccaguaggcaucucuagacaugcuuguuggcagucugccuguccucuuuaaagaaauguuggcugaacccuuaccauccaggcggguguuguaaacuugacuuucuauuguugaguuguaaaaggucgccaucaucucuuccuccuuuuauuuaugugugugugugugugugaguguguguguguguguguuuuaagaacugaucaugggauugaaauaauuugaguuucuauccaaggucaaacacacuuagauuuucccauuaauaguaauuuagaauaaagcaggggaaaaaugaaauaaauuaaauuuccuucuugucugacauguaauuuuuguuagguuucaggauugugaacauguacugauuuaggaaacugcaucaccaucucccaaagacauuuugaagcagcuagcacagaccucagaucugcucccauucuccucauuaaaauguguauuguguccgugggccccagagcccccaagagcuagcacaucagagcccccaagaccacuuuucacaugugaucaagaugcagcuuucucuucaugaaaaauauuccuauuuuauugugauaaaggcaaaucauccccauuaauguuguuuguuuguuucuuuguuuugagacaggguauccguauagccuuggcuguucuagaacuuucuaucuagaccaggcuagccuccaacucacagaauucuaccugccucugcuucccaagagcugggauuaaaggugugccagaauuuaucuggaagugccagagucuuauuuuuuugcugugcccauuuuaguaccaacaucauuugugcccuuugcugggagauuugccuggcagcugugugcacccaccagagaccucgggcuuaccuugaagcagcccagugaagugggggugcuuuccucaaucugucuucucuuucugacaguuauccaauuguaugccaguguaguguuugccuuagauuguccugccugucucuacugugucacuugaguuuccuguucuauaagacugucggaacuaaauggcaucauacacagauagcaaguggaaaugacaccaggcaaagcaucacccgugggagcacacagauacacauacauaggaggccaucuuuaacacauguacauggaggacacauauccauaccugggaggccaugcacacacacaugcacacuugugcugcugccuuguuuguuuuuguuugguuuucagggauagagucuugauguguaagccaggguaguagccuugaauuuauggcaggcccccccuccauguauuaccauauccagcuuuuugacaauuuagguuacaaccuaaguccaggcgugguaguucaggccuuuaaucccagcacuuggaagacaggcagcucucugaguuccaggccaacuaagacuacaugguaagaccuugucuccaaaaauaaauuaauaacaaccuaauccuguaauaaucucggguaccacggacaucagccaacuagaguggugucuacacacaagcacugcuaacuguauuuuguacauuuguuuuaaguaguagaaaugggcugguggcugguuaugguggugcauacuaguaaucccagcacuuuggaggcuaaugcagaagaauaucauaaguucaaagccagccugggcuauauagugaguagcaagccagguagggcuacagagcaaaacccugucuaaaaaaaccccaaaaagcaugagcuuaggaaauaaaggcagggauugauguucaaagguagagcacagaggccacagguuccauucucaacacagauaacucagucagcaaggugacugucaugcaccugaucccaagcucccaagaaaaagccaggggaaguagagacaggcagauccuugggacuugguggccagccacccuaacuaaugagugacccugucucaaacaaaguagacuccugagaaacaguacagaggauugaccucugaccuuugcucacacauuuacacacacgugcacaugcauauauacagagagagagagagagagagagagagaucaguuuucauuguuugcaaguacuuuaaauucuuuccuucacuaagcugaccauaaaguuugaaaucaugagugcuugcuagugcuucuuucagguuggccaugccuggcuaaagcuuagagcaggggaauuuuuucacauagauaacguaugugagcaucggugauguccauccagcuaacuagcaagaaguuaaagcagcacagccgcacuccgccuuccaucaggguugcuuuauaacuagugacagagaagucaccuucccuucaugcccguaauaauuguuuauaaacugcauugagaucgugaacuauccagugcugccaacuuggaaggcacuagucacuuauuuguugauuggcagugggacacgaagcucugcccaguucccugucucuugcccuugcccagaucacgguguuccaagccuugcugcagagcugggagaggaaggugcaggguggaucuaacaccugucaguuugggccucacccuaugaguucacugggaaucauuguuuggaaggaucagaucuuuaaaaugagguagaagaaaugcuucucaaauaagguaacagauaaugaggaaaacauuacacccagccagagugcucauugcacgggcagcuccuguuggagcaguaacuguuucuccauugucucgauuuuuucccaguuaauuuuuuuuuuuuuuuuuuuuuuuuuuuacugccaaacaagccuguagcugcagcuacuggagaggcugaggugggaagaacucugaagcucagaaaucaugagaucagccuggacaguacaguguggcucugucccaaucagucaaugagcagauccauacuauaauuuccuuuuucuuuaaauaaauuuauuuucaaauaaaauugccuuuuuuuguuuguuuguuuuuuuuuguuuuuugagacaggguuucucuguauagcccuggcuguccuggaacucacuuuguagaccaggcuggccuugaacucagaaauccgccugccucugccuccccaguacugggauuaaaggcgugugccaccacgccuggcauaaaauugccuuuuuaaagagauuuuuuuaaaaaaauauuuauuuuguaucuacuuacguacaugugugccaugguacaugugugggggucagagggcaucuuacaauagucagguuuuuuucucuuucuaccaugugggucccagguaucaaacucagaaaaacagcauuggcagcaagugcuuuuacuuacugaggcaucucgcugauccagaguccccauuuuucugucuggagauuguguugguuuacauggguuuuguuuguuuguuuuauuuuuauuuuuuuaaagauguauuuauuuuauuuuauguauaugaguacacuguagauguacagaugguugugagccuucaugugguugucgggaauugaauuuuaggaccucugcucacuccagucaacccugcucacuguggucagccccacucgcucagucccuauucaaucuggcucaaagauuuauuuauuauuauauguaaguacacugcggcuaucuucugacacaccagaagagggcgucagaucucauuaugggugguugugagccaccaugugguuauugucuucagacacaccagaagagggcaucagauccuauuacagaugguugugaaccaccaugugguugcugggauuugaacucaggaccuucagaagagcagucagugcucuuacccgcugagccaucucaccagcccguuuguuuguuuuauuagagacagaauguuguauaugugguccuggcuggccccaaacuuacaaaccccuaucagccuacaaaccuacugaugcuggagagcacaggcauguaccaccacacccagcuucaaaaccugacuugaagcuuugcaagaggcuuuuuaugccucuguaaaaugggggguugggagggagcucagagauuaagggaacuuguugcucuuacagagaaacagaaauguuuucuugccagagacauggaggcuuuagugcugcugaccuccagucugaauggagucuaagggcuauguuuagcuuaagaguuugaauaggcaaccuugcuuagcuuuaaaggcuagcucaucagggcucccccaagacaacaucaggggugaguaccugccaggugacacaggcugggaaucccagcccuccuguguacccacaaaagacagagucacugcacuguaaagucuuccugcuuuccagggcauuucccugauucuuccauggguguacaaguucaggcuccauuuuguuuguuuuggggguuuuguuuuguuuugguuauuauuuuguuuuguuuuguuuuguuuuguuuuguuuuguuugagacugugugugugugugugugugugugugugugugugugugaaugguaguaguaguaauaguaguaguaguagcagcaguagucauagucauaguaguuucuauaggaacuagcuauauagaccaggcuggucuccaauucauagagacuccccugcuucugccucccaagugcuaagauuaaagguacgugccaccacccucagucucaguuuuguucuuaaccagucaaaggucacaucagcccugaugagaaaauacgcaguguacuuuuguggggcgucuaggggaaaguuguuuuguagccaggugugguggcucaucccucucauccuagcacuuagggggcugagacagcaaaauugcuguacguuuaaggcuaaccugggcuauguaguaguuccaagccagucuggacuacaaagcaagauccugucucaagaaaccaauaaauaacaauaauaaaauugcaaacucuucccaguuuacauaaaaaagggucuguaagugaauucucuucuaguuuauucuggguuucaccacauuuaguccagccccuaaaucuccccagucccccaagcugccugcaaguaaacacccucccuguucuucagucccugacggugcugucccucuauggcaguggcugucaaccuccuaacgcuguaacacugauacagcuccucaugcuguggggacugccaaccauaaaguuauuuuuguugcuacuucauagcuguaauugugcuacuguugugaaucauaauguaaauaucugauaugcaggaugucugacaugcgaccccuaugaaaaggggucuaugggcuuagguguucucauuccucugcuuagugauguggcgagcacacuuuacaugaugucugcuuaggugagaaggcugccugaagcauuagugggaaccucggaggcggaguggagccugcgcuccaugccacuggugaggcaggcggcuugcucacuuuuacuccaaagcggccucugugucagacgaugccaaucccugugauaccaaguagugacuaauuuccacccccgacucccguuuccauuaacagguuaacacuguuccccugcaggggcucucaagcuuggcucuguccugucuguuucagaugccuuggcagaacguggagcauguuggugaccagagcccuuaugucacuucuguuauucuucacauuaagcaaaacguccccaucauccgugacaaccuggcuuccacacggaaauacuucacacaguucugcauuaaauuugcaaaguaaguccugaguuguucugcuuucuugaugcacuuucuguuucagucucccaggagagccaagcagcagcacagagaugccuguguacccuuccauucuugaccauauccuucaggaaccaugcugacgggguacaaaccugugacccccaagaucacucucgaggcgucucuuucugaguugcaggagauuguuaaugguucugguacucaauaaaguuauuucacugcagugcuuagccucccagcaggcccacaaauccaggugucccaucuucugguggggcucauucugggaccuccaggaaaacuacuaucuucuguaccccaaagggcuauaaugguaaaagcaaauggaccacuucaggucaugugcaugcuuaugacagcagucaccagccauggcagagccaccaaaagugauguguucuuuugaaauuugcccaugaaaccacuccuugcccaggcuuuuauuuuucaguaaguuccugugugcguuuugucucugacuggauuauaagcuucucaaggguugggcccaucaguuguaccuuugagccuuaacuuccucccccuccaccacaggacuuguuauaguggccagaaaccaucuacuucugaauauccuuaugugcagggaaaauacuagaaauugggaccaggaacaagcaccaaguugccugccuucuuguuguguccucguguguggcuauuucggccuugaauuuugaagcaaggaaguaguuugguucuuugccagucagcaucuggcuccagcacuccuucccgagaggccaggcagugaugagcgccagugucuccucugaccaauuaucagaugcacaauuuggcagguugcuccaggaaggucagugcuguccaagcuaccguauuuggauuguuuucguccaggucccaacuggugacucaggauucugagauucucuuuucuccagaucucucccgguuuguauucaauuagauuuuccccaucugacauaaauaaacccccaaggaacaacaaugacagaguagcuguaaaguuaacuuuaguuucaaccucaucaggaaggcuuggacugacucccuagggagcauuuauguuugcuggccacagauggaccaggagcugacauuccccucucucucuggaugcucauuaauguguacuaaaagcaucgcugauaaaucacaugugacguucccuguaaccacugcuacaagugucucuguaaaaauuuacugugacucaaaaaucuccauuguaggcacccagggguccgauugagcuaagguuaaagugaauaaggaguccguugcucaguccauccaagugucaacuucacauucucucaucaccuuuuaauuuuagcacuaagcucacucugagugaucugggaauagggugcccaucacccacaucuggaaaaguuuaacggaggaccuagaaaguuuugugcuuuaacucuugguaccuucccaucuuuauaaaaaucucagcccagagcaguagccacugcuucuauccugguggcccuuggcagugacacaucucuuugcuggggugucuucuccagagaagacaugugucuggauuaucuccauguuuccccagcccacccacuauggacuagucagggcaaguucaagggccagccacagcauaaucuagugugaagugguuuccaugacaaacuguacgggcccgugugaugagucccaaacucagccucccuuuacucauuuggcucagguuagguucugagaagcccuuccagauagcuucuuguucacaccuccucuagaucagcagguccacaccuggaucugacugcuggacuucagguccuuuucccauugccuccuuucauacuccacaauugcugguccaucugugacuauauuggcuccaauagcagccuuuccuaaugacuugccaaggucacuacugguugaaacuaguuuggaucauaaaugacuucucuugcccacuaagcuaguaugccucuuugaaauucccuagcacgcagugauuacagugugcaggaaaagguguggugagauugaagggggaggacacggcaggcacagacccagcgugcuagagggaggagacagguagcagccagcgucuguggaaacccuucuuccccuuuucaugcuuccucugagggccugggcccggccaccucgcucagcucacucugggucuugcuuguuaugcacaagucugucuuucauagcuuuugaacuacaucagcacaacgcagccuucuucuucuucucuguguaguuucucuguguagcccuggcuguccuggaacucacucuguagaccaggcuggccucgaacucagaaaucugccugccucugccucccgagugcugggaguaaaggccugcgacaccacgauccaaguugucccuuagugcucagcagauuuuuagaaaaucaugugauuuuuguuuguuuguuuguuuauugauaagagaauuaccacccuagcaauuauuucuugguuuugcuuuaagauacccuaacugcccauguaguucacucuugccacuauugggguauuuucagcuacugguacucaaauggacuugaguggcaaaguguauuuuuauuguauuguuuuguguuguuguuuuauuuuguuuuguuuuuugagacaucauugcacuguguaacccuggauguccuagaacucauuauguagaccaggcugaccuugaacucacaagagaucuaccugccucuccagagugcugggauuaaaggugugugccaccgcaccuggcacaagauggauuuuaaauuuuuccuauaaccucaagccuagaggaaauuaggauagacuuaagagugguugguuuaggggagagauagcuuaguaguuaagagcacagacugcuccaucagaggucccuagaucaguucucaguacucacauggaacauggaacauggaacagcucacaauugccuauaacuccagcuccaagggucucaaugugcccuuccagccuccauggcacaugcacacauguuuacaugcacacacagacauauacacuaaaauaaaaaugcauuuuuuaaagacagagaaugugauugcuuuaggguuucagugguuucauugagauagucagcugucuuugagacugggcacacccucggaaugauaggaggaagacaagcauaggcguguguuauauaacucaguuauaugggcucaguguccuaggcaacagccuugucucgaggugcuucccuccaggugauuagacuugcauagaguaauucccucugagggaccuaaaacagucaccaguggaccuaacuggcugaagcucaguagaauugcccucaacaggacuggaguguggcucagugguagaguacuugccugccauaugccaggaccuggguuccauccccaguaauucaccccuguagcuuaagauuuaagggaugagcuuuccccuagaacaucaaggcuauucuucccuaaacaaaucuggagcuaaacuagaaggaaagagaaugaggugaaugguggcgugggggaugugaguguccaccuccauucucggcuuucuuaugagagguaguagagccuuaacaaguuucugcacacuuuacuagaaagagaguaagccuaacuuguuacuuuuuauccacaguucguucauucccaaauucaucacccaccucuucaaguguaagccgaucagcauggugggagcagagcagguaaggcaagcuuuguaugggaccucgccaucagccuuuguauagauccagcacacauucucaaguagauagucugaagagacugagacugguuucccugguguagggagcuauggucaccuggcggcuccuuuugcuucuuuguuuugucuuuugagguagguucccauauuguagcccagacuggucucagauccguuagauaagcauauccucaccaaguguacagaacaagguugcagaaacugucuuggggcgugaggagugaaggcuuugggcuucucugaggguugcugcuggaaggagaagaugcgguguucuuaguacagcagaggcccuggguguugcugugcagagccacaggagaaaucaagcagggagggccugagcucgaaucccuaggaagcuccuugucgggcuccuuucuccccgucugaauucuccucugaagcaugaugacggcacgccugugaucccagcagguaggaggcuaacaguacgauuuugaauccaaggccaauguacaauauauauugagacccugucuuaaaccaaaagacuugguuaaugucaccugaauacuggugaacugaguucaucaacuacagcgucacuuugaguuugucucccaccuguucggucugccuggaauuugggcaguuugaguucagggaacacuuugagugauuuaaaaaauaaaaacagggcuggagaaauggcuuagugguuaagagcacugacugcucuuccgaagguccugaguucaaaucccagcaaccacgugguggcucacaaccaucugaaaugagaucugacacccucuucugguucaucugaagacagcuacaguguacuuagauauaauaauaaauaaaucuuuuuuaaaaaaauaaauaacaauaaaaacagggauuagggagauugcucugugauaaacacugaccaaaaucaacuugaggaagaaaugguuuauuuucauacaggucacaguucaucaucaaggggagcuaagauaggaacugaaacagaggccauggagaaaacugcuuacuggcuugcucuccauggcuugcucaauuugaucucuuucuuauggaacccgggaccaccaggcuaaggguggcaccacccacaaucgucuuggucugggcccucuugcaccaaucaguaaucaaguaaguuccccacagacaugcccauaggccagucugauggaggcaacuccucaguugagguucccucaacucagguaacucuaguuugugacaaguugacaaaaacuaauuagcacgccaugcaagggugugggucugaguuugaucuccauaaaaagcacccacauaacaggacuaaagauggcucaacauuuaagaucacuuccuacucuugcagaaaaccuggauucugguuccaaaaccuacucugggcaggucauagcaccuguaccuucaguccuggggcaucugaugccuucuucuguccuucacaggcacugcacacacauggcaugcagauagacaaacagacacacaaacguaaacaucaguaaagcacacuuaaaauaggaacaagaguggucguguguuccagcaauggggaggggcaaacaagagggucccugggguuuacuggcuaaucaagcuuaaucaacaagacccuaucugaagaacaaagguggaaagcaauugaggaagauacucggugucugccuugaccuacacacacacacacaaauauuuacuacuccgaccucugaaaauaccauauaaaguguaaacuguucacaggcaaaucaagaacaacucauagucaacuccaucugugaacacuuaggcuacauguaagaagauuguguaauucauuuccauagauccugcccaguaccaaacaaagcaaugagguagaggcucaacucuuucccagcucagugcccugcccuugugguuccuuggcuguguugacagccaaccccaccccucacccccagccccagcccuugucucugggucaggaagauugcuaguuaagcauguauuggaauacucaugaagugucaaaggcagguagcaacaucuugaaucuaagugcaauaugauuuuguccccucugucagcaaguacaggacacuugaguacucaggcucugagcucuggaguggcaugagcagaggcuggacccugugcccacaacagugcaucuguuugugcauagguacuuuacaggaccuccauuuccugucucugaaauagugcuuagaacuaccccaugaaguagcugugaggguuaaacaaaauagagcgguaugugguggcauacaccaguaaucccagaccuuggggaagcugagggauuguaaguuugaggacaaccuaggcuauagagcuagauauugucucagaauaaaauaaaacaaaauuaguaaaaauuaaacccagugcccauaagcaagacgcacggcugucauguagccagcccuuauuaaacaccagcccugcucacuguaaacuuccgaagacccggacaugaccuuguuucuguuucauuguucgucugcucugauaccuauccacaugcaaccugcaugaagacuucuagucagagcuugcccucggcugucugccugaccagcuccagcccgagucaaaaauguugucuuggaaaacucccugggagguuguacgacucagacaccagcugggcuugacugcagcagucgguguucugaaauccugacccuggcauguccggagcacaaugcucauucucuccaucggaaguggcagagcgaggcccucacaugccagcuccaguuucauuagugaauguuuaccaggcacucacucuuuggccucauuacagugugccaucuaagaggauauggagugauuaagaucugugucugggagcagccguaggguucucaguuacauuucugucuacagacuugaccaagccucuggaauccaaagcugacucaugggaacaguucuguguuuuguagccuugcucaggccucuugagacugguguagugucuaacagccauggaaguuuggauguugucacauaaguccuauaccaugacuguuuuccucaaauguucucuuguauaaaacaaucucagcuggagaaagguaggggcauaucugccacacagcacauucaggaagcaaaagcaggagaguuguaaauucaaggccagugugcgcuguguaauaugacccugucucgaauaacagaacagaaucagacucugggauguuaucucaggagcaggacguuuggccaguguucacaucugcuuuuaguugccugugagaagcccaucuucuauagcuaagucucauuucucauaccccaagcaaagacaauaagcaguaauagguggcuauucacacaacuaccuguagaggcuuuaaggaagagucaagggcaauguggcccuucagugguucccauguguaguucagguuaucuguguaagguuagcccuggcaucugaacucugaaauccaagccaugauguagcuagaggucuguucacuuaggcaguagguccaaggaaucaagaaauuaauaaaggggccggagaguugacccagcggguaagagcagucguuguugcucuuauagacuacuugaacggauaggcugccucacucauacucucucucucucucucucucucucucucucucacacacacacacacacacacacacacacacauacacacacagaguauaauaaaaucaauuuuugaaagaaaauuaauagagagaugcuuguggguagaaacacauuuugacacacucugccuugcgucauggcccugacccaagcuuuaacuaaagcuguagaauucaaagcuacggcugagccucuucuuccaauaggugcuagauaucuccuagguugagguuaggcuugaauauagaugugagaaauaaaaaaggagcccuugcugcuccuuauucuugacuugauuaguacauacagugaguuauuuaucuucaggccccagaguccucuugagcgguuacaagggcacguggaauugaaccguuccuguauuguaauacuccuugcugguuugugauuuucagagaaucuugugggauuugcagggucauuaauuagucuuacaacggaggucaucugugacugaacacagcagaaauaaaauccauuugccuaaacuuacccuagagaaaacagucuagugugguguuggaaaagaugcacaguccucgcucugcuguugauggcccccuuguucccacaucacuccugucugcgccaugcucacuguccuauuucaauaaaagcacugaaacaggcacucuccacaggcccuucuaguccuuccccacugcuaaaaccucauguuugucaaguuacuuuuucuuucauguguuaucguuauuuauuugguuuugguuuucaaacaguacucuacuauguaacccauaguuccaaauaaaugccuucaaauaaauccacaaaccuccugcaucagccugcugaaggacagaaugauaagcaugcagaccaccaugcccaguuuacagcauaucuaggggauggaaauacggcuuaaugaucaagcacaugcuugguguauguaagaucccagguuacauucucagcaccauaaaaaaagaaucuuucuggauaugucccaguggaacauuuugaaacuguacauaacaucgaacaugccgucuucuagugugcagcucacuggcauuaaguguagauguugcugaggaucugucaugaagaugaucuccaaagugaaccucugcaccaucuaaccacugcucccaccauagccccguccgucucugagucugacacucuucaaagaagugcgagaagacagcaguugucuuuugugcucuuuuaaccuagccucaugucaucagaaauccuuuuaagaguuucacuguuuccaagaaugagaaaguaagaggguuauucucaggcacaucucuucuauggagccuucagagagcagggcuucuucauuaaaaggaaaaggggcucaguaguuaagagcacugucugcucuuucagagaaccaagguucaguucccaguacccacauugcagcucacaaccaucuguaacucaggcaaucagaugucucuucuuugcucuguaaguucuuguguguagcugguguauguauacacacauacacauaaaauaauuagauauuuuuccaaaaagaggccaggcauggugaugcacaccuuuaguuucagcauuagagaaucagaggcaaacagaucucuguaaguucaaggcuggccuggacuguaugaugaguucugggucagccaaagauauauaaugagacaauaaauaaauacauacauacauacauacauaaauacauaaaugcauacauaaauacauaaaugcuuuguccaaacaaaugguagaauuaauuauucaucuaauagcaaaaauuuaaacuuuaaaguauaaauaugguaacuguugaauugauaaaagauauuuuaaaagugauaauucaugcacaguagcaaaauucuagguguuagagguagagacaggagacucagaguucaagauuacccuuggcuaaguagugagucugaggccagcuugaaauauacaagaugcugucucaaaagugcuuugaaaggcaaauguuacauguuauaaacauuugucaaaauuacaguuaagaauuauauuaggaagcuagacaguggugaagcaugccuuuauuccuagcacuugagaggcagaggcagaggaccucugaguucaaggccagccugcucuauagagaagguucuagaacaaccaggacuacauaaagaaacccugucuugcagggcgugguggcgcacgccuuuaaucccagcacucgggaggcagagacagguggauuucugaguucgaggccagccuggucuacauagugaguuccaggacagccagggcuacacagagaaacccugucucgaaaaaaccaaaaacaaaaaaaaaaaaaacaaaaagaaacccugucucaaaaaaacaaaauaaauaaauugauuaauaauaguaaugauaauaauaaaagaaagaaaaagaaucauuaacauguuaaugaauacauguuuuuaaguauuguacauuucaggauauguacauuuuaccucagagggaaaagaaacgaguggccagaugugaaugccaggauuccucaguaccugcauugcugacagcaggcuaggcaggcuuuugcuguggacccuguuaaacaguacccgguacuucugccaccuagagguugacaaccaaagaugucuccagacucgcccagaaaacacagaggugccccuugucuagugucucuggaguagagcagugagugagugaggaggacagauguugguaccaaucuacuggccacauauguuugaaauccaccuugaggacaggauuuaaaagagugggaguuccacucccacauguaccacucgugaacaaagggagauuuuauucucggacuagauagaaaauuccacauuuccugaaauugaacuaauuuccuuccagaucuucccaccccacccccaaccccuuguugugcugggauuggacccagaggcucacaugggaggcaagcacuuuacacugagcugcauccuggacuccugcauccagguuucugauuguggaaucacauucagaaaguuggguguccucucucuucucuuguucucacaugggugcuccugcccacggagcugauguuugcccuucuucacagcaaaccaucuuucugaagagcugcuacuccccugcuaugcacucaugucugccuccuugucaagcucuggcccacuaugcugcuucugaagccaucuuuccuaggagaaugccacccuccccugucacucagucaucaaggcccuuccuuccugccacacuccacacucacuaagaggcaaucccugcuacaccccagggagggcuuacagcacagaaaugagaaggcugagcugcacuggccaugagccaguuaagggcaaagaugacagcaaaugccagacacaauagccagacacagaagucuccuaccucacaaauaagguaucugauaucacuacuucuaucccuuauugccugugugcccuuaacgaggacaguaaauguuuaaaaaauuaacucacaacucugaaaacuauuuaaauggcucucuaguuaagaguacauucuggggcuggcgagauggcucaguggguaagagaacccgacugcucuucugaagguccagaguucaaaucccagcaaccacaugguggcucacaaccauccguaacaagaucugacucaucuggagugucugaagacagcuacaguguacuuacauauaauaauaaauaaaucuuuaaaaaaaaaaaaaaagaguacauucugcucucauagaggacuggaguucaguucccagcacccacauggcagcucacggucaccuguaacuccaaauuuccuuaugccucuuacuuuccucuugaggcaccugcacacacacuugcaugcgcgcgcagacacacacacacacacacacacacacacacacgcacgcacgcaugcacaugcacucacacaaauuaaaaauaaaaucuuugccaggcauguugugcacaccuuuaaucccagcucucaggaggcagaggcaggugaaucccuugaguuugaggcugaccuguguuuauguaguauguuuacauucuauuguuuacauaggaaguuuuaggagagcaagacuacuuagagagacccugucucaaaaaaacaaaaacuuacauaaauuuagaaaggcugcugaaacugaaguccacauuagaaauguguuucuuggaucuggggcucacugggagagugugugaacaguugccagcucacaguucagucuccagcaugaccaaauaaauacauuccuguuuguaaucaacagucacgaaaauguuauuuuuuauuuuuauuguuuuauuuuauguguauaggugauucaucuacauguaccaaaugcaugccugauacccacagaggcuagaaagggauguuggaucucuuggaacuggaguuacagaugauugugagcuaccaugaaggugcugggaauugaacccagguccucuguaaaaucaacaagugcuaacugcugagucauuucucuagcccuugggauuggaaauuuuaaaugaaaccauuucuuuuugagugugguggcauauaccuauaauuccagcuagcugggacacucagacaagacggucauaaauucaauggaagacuagguagcaggcugggaacccaucucaagaaaacaaaaccuauuuccaguagcagcagaaagcacugacugccuugaagcaaauuuuaucaaaagcuguacagucauucuagaggagaaacugcacaaugcuaagggguccuuaggcaggccuggugaugcucggaggcugaggugggaagauggagagcuugaagccgcuugguuuuauagggaguuccaaucagccuaagcuauaggguaagaccuugccucagucaguugggggcgguaggggggcuggugucucaugaaguuuuccuuuacuggguacugaucuuucccaggcagagcugcuuggccagucugcccaccucaaaucaucucugagguguaaguaaauuggccguggccccuccuugccuagugccucgugcuuaagcagaugcacugaggucaguuuugaagaaugaggccagcagauagugguaaucaaugggagcuuuuaucuucccccaacagcaguucccgucucucgggaucacgcugcuccgugcaauagugagagugagguucccaucuuuccagcugucuagcaaggugggauuuuccugugacuggccagaggcaagcgugucauaccuccuuaagauauggaauacgcuagagaauuaugucuggcucauucaaaaucuuccucucacuuaagccuauauaauuauuuaugcauguacuaugucucugggaaguagaaaagguagcaggcauccccagauguuugaaauagauuuuugucccaauaggccacggauuugauuuugacagacaaggcuccuaauuuguuacaaaauugaaucuuugccaggccucaaaagacacacuuaaaaagaaaaagauauuucuuguuaacaaugucuagaaaauaaaucaaacagguagugacuagucagugaaauauguacuguguuccuacucugcaucucugaaaauuucaaggucguuaggguucuuguugaaguccccaguggagucccagccuucccucaccaccccccacgcccagaagugagcacuauucugauuuagguuucuagauugccauauguguuuggguguuccauacauguauauauucccaaaugaugcauggguuguuuugcuuauuucuaagcuuuauauaaauuauacuugcgugucauuuccucucuugccuuuccccccaccuaacauucuuugagauuuauuuguguugaucaguguaauuuguucacucaugucagcuucgguaucauuucccuucgcauaaauaugccaacauucguuuacucauucuuguuuuauggacacugagcuguuuccaguccuugcuuguccaaagagugggcccuggaaguucuuuuuagcgugaguguuaggaguugaaugcaccuuuggcuagaguguuaaaugauuaguagcuccuggauggucacaguuuugaaagguucuggaacgcuuaagaggugcaggauaguuggaggaaguacgucacuggggguaugucguugaggacuauaucuugucaugaagucuauaucaugucuucuucauacuucucuacaacgagguaaagaaacuccccacugcacacuucugccaccauuauguucuguugaaacacaugaggccagguaaccucagacugacuacucugagacugugcgucagaaagaaccuucugaagccgccugcggccacaccaacugggucccugagugggaggccagagcuguauggaaggaaacggcgagagcaauaauggaggccaagauauguuucuguucaaggcccccaaaguuuacuaaaagucugugcuuauaaagugggggaggcccaucccccgccaauccauucuuggugccuguugccagccuguaggcagaucugccggaugcugucuccggaauaucuccagggccucucaucagauagcagugucuuggagaagagcaguggcaggugacagaagguuccaccccagguggucucaugcucaguggcagcaaagucugaaucagcuucaaggcugggggaggcuccaaucuuccaucccuuaaguuuacauacucggucauagcaaccaaaguuaagaauaugacaaccaaggauuucuccuugugauguaacuaaaagacauauaguugcauguugguuuugaaacaguaucucuauguagccagugcuacgcuggaaguuguacauagcccaggcuggccucauacuugucacagucugccugccucuacccucgaaggguugagcucagcaccaccccgaugggcuauguggaucuacaagcaagaaaauacuccugcauuccccucaaagggcucgaacuaauucacucuguccccuugagcuuggacuuccgugcuguauucucagccagcacuuuuugugugugaggugcugguguuggaaccagggccaugugcaugcugcaaauacucugcauuggaguacacccacccugauuacccaucuguguguguccugcuccucuuucccuugccaguguggcucucgucugaggcugguucaaucugggauuuacagggagucucauauaacuuagaguaguguauuuuucaaucuuucccauauuugacauucuuuucuagccacaagcaauaaaaaaaaucucuauuuucuuuuaaaaguuugaccauuuggggcuguugagagguggcucugcaguucagagcacuugccagaggacugggucugguucccagcagccaugucaggaagcucauaaccaccuguaauucucacuccagauaaucugaugguccaccagccuuugugggcacauacacacaacuaaguaguaaacuuacucuuuagccauaguggcaaaugccuuuaauccuaccauuugggaggcagagccaggcagaucuaaguaacuuugaagccagccaggucucuauagcaaguuccaggccagccagggcuacauaaagagacccugucucaaaaaaauaaaauaaaauaaaaaauuuuuuaaaaagcuuuaaaguguucuuuuucauauccuagguccuuagcuaugugaaauuacacagaaauaaucuuuuucuuugaaacagggucucggcuauuucacccaggguggucuugaacuccuggguucaagugacccucccacuucagcuucccaagucacugggauuguaggguacacaccaugggccuuggacccacuaccuuguucuuuacaagugugugggaaacaauguaaaugccaagggaguaugcuaaaccugggcuccugcugugggccugagcauucugggccguucucucagaagccgagcacuucucugugaacucuuggccuuuccauaaagcaaacacuacggugguaagaauuccucuuagagcugcuagguuaaccugagucgggauccucagaacccacauaaaagccagcaugccugcaggccuaauacuagaguuuggagacacaauagauccuggaggccaccuagccagcccacccagccuguuagugagcuccagguucagugagagccugucaaaugggguggagaacaauaggaggauaucuaagagugacgcuggcucuucacacacacagucacccauacacaccacacaccugacuucaaaugaauuucuaaaacaaaagcaguaagauuacuuagcugccccgaaguugaauaacuuagcaagucugggcucuggggucugggaagauggcucaaaggacaaaagcacuugccaaucaagcauaaaggaccuggguugaaauggacaagacccacauaaggcuuggcacagucgugcacaucucuaaucccagcacuccuaaggcaagagaggagcuagcucagcaaaggauaaaggcugaaguugacaggcagcuagccuugaccccugcuacacagugcaguggcaaaaggaucagggagacucugcuuccaaacgaggugaaaggagagcaccagcauuccagacuguccucugaccuccacacgugcauggcuugcacaugccugcauaccuuagacacagagagaaaacuuaggcuuuuaacuacccacauuccuucaugaaauuacugucauuagaguagccuucuuugccauuuuuagagaguaauauuucuuaguuaucuaaacuaagcauuaauauuccccaaauccuuguagcacuuuugaaauuauaaucacuguaaccauuaaguggacuguaccucucauugguuauauugucuuuaguuaguaacucaccugcccaauacaggggaaaggaaggauagagagugccaaaggccuuaaggaaucccacuccuugccaacuagcuauaauuaugaaaggcuaucugacggguccuugggccuguccugaaugucuuaacuaccgucugagucuaguaguagcugagagaucuguccuccuacugcaggcuccauuugagccccauugggcucauccuggggccaugugauucuguucucuuaaacgauuuaaacagaucaaggcauacccuccugacugcagccauuucauucuuaguucauuuuugcagugcuugugaucaaacuuggucuuguuugguuucuuguuuuuuguuuuucgagacaggguuucucuguauagcccuggcuguccuggaacucacuuuguagaccaggcuggccucgaacucagagauccaccugccucugccuccugagugcugggauuaaaggcgugcgccaccacgcccggccaaacuuggucuuauucugacuaaugcucuugcacugagcuguacacacaggcccuggcugcagccauuucugugugucuugucaucagugccuggaggccauccugacuuacguugaggucauccacaaaguggaugcucaguguggaccugcuaggugcuggguuauacuggcugcuuauuaacccuuuggagcacugauguucuguccugugcaguugggaauaaugagcucaugaaggaugaccuuccgagagaccgugugaagaaacgccuuccagcagggccauggugguccacuggcauccaggaggaccagagcaaacagaaaauguggguugcugccaggauaugauuaaauaguaaaauaucaucaaauaacaucuagagaaauccuaaauacagcaauaacaaguugccauuuuuuugccuaaugaauaaguaagauuuuugugauaauuuuucagugcugaugagggugcgaucugcggugucugugaugcugguagcuguguaaacaggggcauucuauguagaaagagauucagacauguccugggaaccuucacaauacgcuauuuguccuguccccgggacucuccccuaaggagauaccacugcugaugcuagagucagccaugacgcucucucccucagcaucuggggguuuggguuuugcuauuuuuuuaggucuuuuuuuuuuuuuacauauaugagugguuuuguuuacauguaugcaugcaugcuauugccuguggaggucagaagaaggcauaggauccccuggaacugagguuacagaugguugugagucaccuugaggauucugggaaucaaacugaauaaccacugugccguuucuccagcuaccccacccccacccccacccccacccccagcaucuguuacuaaugacagaaaccuagggagugaauuaaguaggagcaugauauugaaucuuaaacuuacacagucuauauuucauagccacuaaaaaucauaauguuuucaagugucacaaugggaaauaauguguguucuagaaaggucggaugugaaaccauacauacacucagcaugauuugaacuugguuguuaucgcacacacugacuggcagaaacuagacccacauuucacugugauuucuugagguagcuuuuccuggacaguggaauuuuuguuuccuuuaaauucuauuuuccaaguuuucuguagugggaaaggauugcguguacaguggguagugaguguguccaugcucagcguggacaugcuagucacuggguuccaugagugccuauaacagucugcuuugucugcagcuucugcuggacacccacucccugaagaugguccugcucgaccuuccguccauuggcucccagguggugaggaaggccccugccaguuacacuaagauugucgugaaaggcaugacccgggcugaaaugauccuuaaggugugucuccucugggcacucuauucaaaggaguucuggggaguucggguuuugcaaacagucuacccuuuccacuggcccccaagaguuguccacacucugugauguuaaaaaucagugcacaguuaccuagggaucagaaauucuuucugacaggugaauucuguccaacagcugagagucagguggcaaaucaggagagaagcccagagucccuuugccuuucagaaggguuuuaggcccagcugucaugcacucccuuccccagaagcucguuggcuccccauguuuugcaccuuuaagugaacucugaacagauguuguaguaacugaaucuaauugacaaaugggcuuuuuaaagccucauuuaacagagauuguacuuugugcacuggaagagcaacaucugccuccggucuccacuuggccugucagaagggguugacaggcugggagacaaaggcucuguucucaccagagucugacaccuaugggcucuucaggcccauuuucagagugaucugaugauggcaggcaggagaggaaggccgcaguggcauggccuggcugcagaccuuaggaccuggggaaccuagggcacauggcugaggaaagugcaaacuccucacagcucuccuccccagcuggcuugcucaagggaggccagaugcauuuugggaaauaugugcaaagaacuuuugaagaaacugcuccuuaccacuuuucugguacauucucaggaauuccaaacaaaauuagcccacuggggaagaaaaagcauauuccagaaccaaaugagaugaaucugaggauagagaugcugucugucugucuguauauuaacugguaguauauuaacugguaguagaauguggagagacgaaguuccagguuucagguuugcaaaagagucaggccaguuuggguuuuuguucugagaacgucugugagcaucuauuccugcuucugccuccuucuccguggauaacccaccauucaugaaaucccccagcagaggacacugaguuucccagaugguuccuuccaggauuccugauggaauugggagccuccagugugcagggaacuaggaauccauauguuaaaaagcagucuggguaauucagccacuuguggggauggugcucuaauggagccgucagagcauuucugaacauggcuuugcugccaugugagggcagcuuccaauaggcccugcccuccagccugugggcuccugaggaccuacucuuaucuucuccuuugguagguggugauggccccucaugaaccguuggugguauuuguugacaacuacaucaaacuccuuacggacugcaacucagaaaccuuccagaaaauacuggauaugaagguaagcucccuuguucuaagcaucccauuuccccuaaggaguggaguguggguauagaaccuggagggcaccuuaaaauauagguuucuggcuucaccuccccugauugcagggauccuuugcuagaggccgaucccggccacacagauuucagcauccugaagaccacccugcccagcugaagaugggauguggugcaaggaagaauagggcauuguucuucccucugccuuuguuucuccucuuucuaacccuuccccucuccuuccacauucccuguuucuccuuccucaguuuuaucuuccaggcugcugcccaggaccagaauuccccugaaggaagcaagguccucggguucuuggcaucaugcaguuagcccagcacagcucagucugagcgaacugcaagacccaagugugccuccuacuccugccaggcacugcgggccaccgccugaccaguuucucucccuuuccucucaggggcugaagaggagugagcagagcagcaugcuggaacuuuugcggcagaggcucccugccccgcccucggggacagaagguuccagcacccugucgcugauugccccaacaccggagcaggagucaucccgaauccgcaaacuggagaaacugauuaaaaagagacuguaaggagugggaaggcauggccagaguccugaacagccgacuucugcaaacccucacacugaguccugagucuugaagccucugagaacauuacgguuauuaaaguaucucucucauaacaugucuuauuuucuaucucagucauggaagcucagugaaaucuguguuauuaaaaggcauuuuuagauua

SEQ ID NO: 12483 - RNA, 241719 nt, Mus musculus
ccucagccgcucggcucgccgcugcccucaccuccgcgccggccgcccgcccgcccucaggcgggccccggacgccggcccuccaccgcccccgggucgccgggaggacauggccgcacacaggccgguggaauggguccaggccguggucagccgcuucgacgagcagguaacgggccgcggcgggcaggaggugggagcggguggggguggggacgcggugggugaggggaggaaggagcggcugccucucgggcugccgggggcuccgcagaccgaggaagggcuggggugggggggcgacgcuaggggacugcccggggauucggcugugagccggggcucuccuucccuccuaaaccggggggguggggccuugcccgugaccagcccuccauccccuuuaucccagcccuuccgcuugcucuuggugcggggaugagugaccugggggcgcuuucagggccacuccaucuggauuuaaugguucucucuuaacucuccccuuuuagaaggagguagauagggguucccucuucccuuaacccccucccccccauccucguaacuggggauaaccgaaggaacccccagucuguguaugcauccccaguaggagcaagauaauauccugccccacccccauuuucuguagcugccccuugggggcaggaguagggaaagcacagguuuucuuacuuuucugcucggggcgucagcuugccuggaugauguucacaccagcauccuugauagccggaugacacaagguugccuuuugcguuugcaggggaaaccguaguucugaaaugacuccccucccccuuccuugcuugaugaucacaccccccucuccagucccugcuugccagcagccccagaaugaaucuuggcuuuccuaagugagacuccaagaguaaggggagaagggugaaagcaaagggaaaaucuagcuacagacuagacagcagagacagacagcuaggaugugguccuagggccaauaauugugaccaugguuuguuguuguuugacuuguuuuugacucuuugaacccucauugagacuacuugggauggagggaaaaguuuuguaguuuaggaagguugcuuuuuauucgcugaguuuuccacacauaaaauucuaaggcugaugaguagacaacccacacauagccuuuuguccaugagaacuaguuuaauuugaugcuaucuacagauagcuggggcugguuuaaaggaugguugcuuuuuguugcaguucugccaggggguguccucuaaugagagaauuguuuagaauugaaccaaucucuuuuguuuauuggguuuaaucacaaaacugauuaugggagcugacagguaggggaaggguuucuucuuuaauuugaccagcagacauuuuuuuauaggacucaaucuuuugaccuauccgacagaggaagucuacccagaggacacugggaaaccuacacagagcugaauguggugguuauaugacuuuugucccagcacacaggaggucagaggcagguagaucucuguguguuggaggccagccuggucuacagacuacaugccaggaugucaagguuacuaagggagauucugucucaacaccccccccccaaaaaaaacaaaccuacauagauaaaauuuuguagcuaucagagacuucauucauuugguuuccagaccaaaaggcaucaaaacaaacuguuguuguaacccgccugaagaaguaaauauuacuguguaaauugguccaguuauagagcauuagauuucaguagaacauuaaguagaauguuagauucuaaacuugauagaaaagaauugcuguguagaacuuaaaaaaaaaagggauuuaaggggcuaaagagguggguuuagcaguuaaaagcacuuguugcucgggcagaggaccuggguuugauuuccagcauucacacaguguucacaguguaguucacaauugucuguaacuccagucccaagggaucuaaugcucuuuucugaauuguggcaccaggcaagcauguggugcacauaaaugcaaacaaaacacucauacacauaaaauuaaauacauuuaaaaacagauuuaaaaugugccuagaccaguggcucucagccugugggucgagacccuuuugggauugacagacccuuuuacaggugccaccuaagaugauuguaaaacacaagauauuuccauuaugauucauagcaguagcaaaauuaugaaguaguaaugaaauaauuuuaugguugggggucaccacaacaugaugagcuguacuaaaggguugagcaucagggggcuugggaaucugcuggagacaaaccaggacugaacucacagagagcagcaucuuaggggagggcugggaaccacucacuuuaccauuuaccuugauuucuaaaaaaaggcuauauuuuuauuuaugugcacacaugcacacauauacucucucacaccccucacacacacacuuucauacugucacacacacucacacacacacacacacacacacacacacacacacacucucacgaagucacacacuguggcaaccugaaaagugccagaucacuuggaucuggaguuaaaggcagcuauguguugcccgacaugggcgcugggaagaaaacuuggaagaacagcaagugcuuuuaacugcuaagcccucucucagccccaacuuuugcuaagcuuuaaaaguuaaauucaaauuuucuuuuuucuuugcuuuguagcucaggcuguuguggaauuugcuauccagcugaugguagccuugaucugcugacucuucugccacugcccucuaagugcugggauugcaugcauuugcuacuccuaugucuggcuuuuuccuucagcucuuaccuuuggucucuagaccauauuuaucauauaaggaaaagaaaaugcucugaauuuuaaaauuagaaugaugaaugguuuaauaccauauauuguuuauauauguuguaguaucagacucauuuccauuuauuaaaaguuaaggacauuaguuuuuaaacugccauuuuugccaucucuuauauuguaauuaagagaaagauacauaaaauaaauuauucgguacaauguuuucuuacaagcuuucaagaaaugcaguaagaggcgggcuugguggcacacaccuuuaaucccagcagguggauuucugaguucgaggccagccuggucuacaaagugaguuccaggacagccagggcuacacagagaaacccugucuucgaaaaaccaaaaaaaaagaaaaaagaaaaaagaaagaacuguaguaagaagcagcuggccgcuccuugaggccagugaaacaacuauagacaacaagaaaacuaaaaacuuucaauauuuauuuauuuauuuuauguauaugaguacacuguagcuguguagaugguugugaaccuucauguaguuguugggaauugaauuuaggaccucugcucgcugcuccagcccaaagauuuauuuaucauuauacauaaguacaccuuagcuguuuucagaugcaccagaagaggaugucagaucucaucguggauaguugugagccaccaugugguugcuggaauuugaacucgggaccuucagaagagcaguuggugcucuuacccgcugaacuaucuccccagcccaacugaaaacuuuaaaacaguugaaauaacuaagauucucauauacaaaugucaguacacaguagacuuuuuucauccuugguaaauuauaaauucuggcugucaauaguggcacaugccuuccgucccacaugggcucucugaauuugaggccaaccagauuuguauuuggaguuccagagcagucaagacauugauuuugagaugcaaaacaagguauucaagguuuaccuucagaaauuuuuguuaauuuauuauagaagugauaaauggucaguucaaauuagguucaucuaaaauauuuuuuauuauuuguguguguguaguacccucagaggucagaagaagguacuggaucuguuggaccugagguuauagguggguaugagugucccacuuggguacuggaagcaaacucugggacucugaaagagccacaagcagucuuaaccauugagccauuucuccagccccucucccacucaaguuuagcuaacuguugaagagucccccccccccccugcccccuuuguuuuuagugaaaaacagagagacuaaauggcauagcagacgcagagagccuuccugugacaugugucaaaugcuagaucauuagagaaugcuauuucuaagcaucucauagacuuuguuuuaauaacccaugaaguguaguuagaagaguuuacuguucuguuuugcuuuugaggcaagguuucacuauguaguccugaguguucuggugccugccuuuagucucagcacucagaggcagacaaucuuugaguuucaggccagccuggucuacaaagugaggucugggacagccacggugguuauacggagaagcccuaucuugaaaauuuuuuuuuaguuaugaguauguaugugagugugugagccaccuaacggguucagugacucagguccuugggaagagcauauguauucuuagccacuuggcugucucuccagcucuaaagcuguagcuucauucagugagcugcccagcaggugaaagcacuuguuccaagccugaugaccuggguuuggauccucaggacccacuugguggaaggggagacuugauucccuuauauuuguucugugacugcuacaagcugcacugagccacucgagugccccaaaguaauaucaauaaguguaauaaauuauuuuccauauuuaggcaagugaaccaauuauggaaguaaaaaauacuucgacaacuuuuuacauaauaaaauccaguuauuuucuccgauaaggucucacuuuguagcucuggaucuucuggaacucagccuggagagcagccuggucuugaacucacagagauucaucugcuucagccgucuccuccccccaggacugggauuaaaggcauauaccaccaggccugauugaagaaaaccuaauuauuaaauuuauaauagcauguuguuauccucauacauugaauacuaaucagacuauucuuugaauacaacgugguagagaguucacaguauaaaaugaugagcauguaucuucaauauuauaaaucccaugcuaauuggccacaaagauuuguaaaaauucaaaccuacucuggguuaauaaaaaggaucuauccucccuaacuccuggucugcaaucuuuauuaggcauuaagaacauugaaaaaaaauaaaaaauauaaucuguuauguugaaggcauaguguuuauucuuuuggaauuccucuuuuagaguaauuucuucuugcuguuucucauuuggcaucccagucuuccucuuuauuuagauuuuauuuuauuuuauuuuuacuuuuaaacuuagguuuucuuugggaaggaacuguguccuugguuggcuuucuccugugaacucugcuucccuucccuuccuugccagacacugccuaucuaucuacugucugcucacuccucucuauauagcugugacaacuggcucugcuucaucccuccuagacugcugcguuuuugaaaaggauuucuuuuggagaaacacaguggucuuuucacaguuguaauaaccacuguaauguaccucucccucaaguucccaagacacagcucuuucucauauguacaaauucagauccuucugugucaguaugauaaucagcuugagcagagcuuauccccuuccucuuccuucccuuuccccuuccucuuccuucuuugagaugguuuuacuucguagccugggcugacuuugaacucacugaguagcagaagcuggcuucuaccacccaagcuuccagagugcuagaguaacaguggugggcugcaccuggccagaugcgcucuuucuuuuucuaacagguuugccugucacugaacuggagauucuaaauaggagccugaguuuugcuguuagucaauguuucucuucauaugccagcuggugggucucacaaagauccuauuuguccucauuuauugaaagggaauccagcagaaaagccuuuaaaguucuuuaaaguuuaaauauuggaugaucuuaauaugcuaacaggauuucucuguguagcuccgguuauccuggaacuugcucuguaggccaggcuggccugccuuugccucuacaugaugggauuauaggugugugccaccaccaccacucugcugucuuuuuuuuuuuuuucuuuuuuuuuuuuuugagacagggucucucuuuguggcccuggcugucuuggaccuggaacuuaccagguagacuaggcuggccuugaauguauagauucaccugccuuugccuccaugcuggcuugaaucuauaucuuacuagcauagucaucugaauagagaaugugagcacuuugaaagucuauaaugguaaccaaauauaagcuuauuaugcauuuuccuuacaucuuauuguuuauugcauuuucacuaaggagagugacuaguuagucucuauucccugguaugcuuguugguuagaauauuauacguuauuuuuuagcauuuauuaacaaauauuuaggguacugguaacaucuuuuguaauuuuuggauuccaguaauugauccacuuuuuucuguuuuaucaccuaguuuguggcauacauauaauauggucuucaaguuugagaaguaaagcaaggcugugugaguuaggccggcauugagccaguuguacuuuauuuuaaauauuccaguuugguuuuuuacacaauuuuuacuuggcucaaaauuauuauuauuaucguuaucauaauuauuauuauuaucaucauuacuauuacuacuacuacuacuauuaguguguguguguuugugugcuacaacaugcagaggucaggacagcaguugguucucuucuucugucgugugaguuccagggauugaacucaggucugcacucuuggcaguaagccacugagcuaccuugacaucccaggauuauuuucuucagucugcuuuugaaaaaaggugcuuaacaugaagaauucuguucuuaacuugaaagcuuagugcuaugauaccuaguaagccauuaucaugccuuguuuuuacaucuuauucuuuaacuuacucagacugcaaugggcauguguugucacuguaguguucagguugguguugugaccuucuuucuguacaagccauauuacugaauuauaacagcaugcuucuuaacgauaugguguuucaauugaaaaaagguuuuuccuguauaugucaugcuuauuuuucauugggaguuuuguguuuauguauaagacaaggaaugagagguauaggaaggcucuuguuuuaaauggaaguuuaaggaggagaauguucuauaaaagaaguggaagggggaggauuguggucagcuuaaacuguuaaaaggcuuaggaucaauacugaaguagaauaugagcaucuuaagcuauuugcagggauugacuuguuuauaaaagcgcuggguuguuucauccaccuucucguagaauaccccauuuuguuagggaacggaaagaucagacaaagcuuguccuugagaauagaaaaguuguagugaaugugaauuguugggugguuucagcaaccuguaaauccuguauuguuaugguauagucuguaguugacaguagucagaggugugcugaagagcuggcuuuuagugcaccccacugaagugucuuagaguguaugcaguacacuggauauauuugaccacuuaaaauguuacauguaaguugguugugguggcccauaccucuaaucccagcacuccauagguugagacagauggaucucugugaguucaagacuagccuggucuauauggugaguucugggauagccagggucauauagaggaacccugucucaaggaaaaaaaaaaguuauauaccuaagauaugcaugguuugaguguauguaaaagugacuuuugagccauugguuauauuaucaaaagaacuguugagacagauagccccaagcuaauuugcaauugcaccuauuuuuaaugaagacuuaaguguuacauucccccacccccauagauuguauugauucccuugcaguagcaaugacuucggaugcuaacugaaguuuaaguguaucuuucuauagcgcacagaccauaguccagagccuccaauuugguugagguuugcuacuacagccagcaagcuggugccugcccuuacucauggcuugcagcuuuggaugucuuauccuauuaaauuuuagagaauuuucugagaggaaauaguucccuuacuucacccuccccucugcccaacaaccaaguaagguuguauaucuaguguaaaagguaugauguuaauuuaggcaaugacaguacaauucuaaauaaaaagaauggcuaauuuuuaaucauaauuguauacugagauagugaucuuuucagugauuaugucucauaacauuuucaagugaugcuuuucugcuuguugacagauuuucuuagauuguccucauaaggaaaugauucuuuacaccuuggguuuaccuucacuguguguagcagugugaccucggccacuuuaccucuguaucaguuuucuauucuuucaucuguaaaaugggacuaacaccugucuuagucacaucuugggcucauuuaguguccuaagugugaaucuuguacaugguaggaaguuuuagucacaagaauguaucaauuuauauaguauuguaucucuccuuucaaguuugguaaugaucauuucugcauauaagauauaagaugagggauaccuugaagcugcuucucucucagaugugugcugcacagugagaauauuuauucuuguuuguguggaugagcacgugccacagugcauguguggaguacagcggacagauuugcgggugcauuuccuugcuuccaccuuugugugucugaacuuagguugccaggcuugcauggugugugcuuuaccugcugagcugccuuacccccacccucuucuguugaguuuugagguaggucuaugauagccuaggauggucucaaccuugaccucuugcuucagcuucuugaggcugagguuauagguguguaucaauaaguugauuuucuucucauuuuuaagauauggucuuagguugaugaccuagaacuugugauuuuccugcuucuaugucccaaguguugggggagggucacagaugugcaacaucacaucugguuuguauaguacauuucacuuagaauuugauauacuuggagcagcucuucaaaauuugguaguacuaaagugguuucuggugaguucugggguggcuuugcuuuuaucucugauucucugcuuuuuucaguuucuauuuuuuuguuuagcaauucucuaauauucauuuguaauuguuacauaguugaggauaacguugaacuucugauccuuguaucucuaccaccagagugcugggguuauaacccgugcggcagguaccccugguuuuauguggugugacacugcuucucuagucaugccaggccagugcuuuguaaacugggcugcuccccagcucauugucuugauuuuuagaguauuauuuuuauucuauuuuacuucucuacuacguuggggcuagaaaauaguuuuuaugugucaggcagaucuuucucuuuucauaauucauaagggaguagggaaagaggaacauuuguguuucuuguuuuggacucuuguaagugaaugaucaggaaauggggagagaaaauaggauuuauuuauuuauuuauuuauguuuuuuuuaagaugguuucucuguguaaccuuggcuaccccggaacucauucuguauauucgaaacguaugccuggcuuaucacuuuuauuuuggucaacuguugguagcaaaaaucauugaagaccagaguucucauuucuaccacagcucaaaugcuguauaauucuuugaauguauuaauuuuugucccuauuuugagcuagccuucugauugaaaaaguauccucaucacuaauaaauuagucauagagcuguaguuuggacucugaaauuauauguuauguuucugcuauaacuuuaacagauacuuaucugacuccuuagauuaaaagcaaaguaguaauucauagcuaaggauaugggaaguacagggcgguaccgggggaaaugaguuauuugcaguaccacaacuuagaagcauuguugacuaauuguuuuuuuuauuuuauuuuaauuaauuaauuaauuaauuuuuuuagagacaggguuuuacuauguagcccuugcuagucuggucuagaguagacuggucucagagucacagagauccuccugccucugucuccugagugcuagaauuaaagguauguacuacuaguggcccuacauuguuuuguaauucauuuuuuaaaauuuacaauguuaauauuuuuuaggauuacuuuuuuuuuuuuuuuuuuuuuuuuguuuuuucgagacaggguuucucuguguaucccuggcuguccuggaacucacucuguagaccaggcuguccuggaacucagaaaucugccugccucugccucccaagugcugggauuaaaggcgugggccaccacgccuggcuggauuaccuuuagaaguuuuaagggauuacauguaguuuaaaaaauuuuuuaaaaaauuuuuuauuauuuauagauuauuuuuuuaaagaucuauuuauuuuauguauaugaguacacuguugcugugcagaugguugugagccaucauguuguugcugggaauuaaacucaggaccucuguuccauccagcccugcucacuccggcccaaggauauauuuauuauauguaaguacacuguagcugucuucagauacaccagaagagggcgucagaucucguuacagaugguugugagccaccaugugguuucugagauuugaacucaggaccuuuggaagagcagucaguacucuuuacugcugagcuaucucuccagccccagauuucuuuauuuuuuauuuauaagaguauacugcaguugucuucagacacaccaaaagaggacauugaaucccauuacagaugguugugagccaccaugugguugcugggaauugaacucaggaccucuggaagagcagucagugcucuuaaccucuaagguuaagaaccucuccagcccuaaaaaaaauuuucaaacacauuucauuuuuucuauacugaacaugaauuuuuaucuugaacuagaggguauagcucagugguagaggauuuuuguaguaugcacaaggcucaguguuacuccccaccccccaaaaaaauucaaauuuaaauuccagcaguguaaguuuaaugugagagugugauuucagugagauguauaaauaaugaaaugauuaggguguagauggcuguuaccauggcuuuggcacuaucuagaccagaagcugccacuagagaugcuuaguggguaaagaugcuugcugcuaagccucaccaccugagcuuggucuucuggauccacaugauggggagaaaggacucccccagguuuuccugugacauacacaugcucauggggugcuuccacauaugugcauagggugaauguacaguuacucacacacacauuguuaaaaaaaaacaccaaaaagauuaagaugaagccaggagcugugguaccugccuauaacccuagcauuugggagcugaggcaggaggacaagauuucaggaucaggaugggcuaguuaaaccuugucuccauucuuacgugugaggugacagagauggagggagcuugcuuaaaguaguuagggaaaucauggccugguguggagggaggaaggauuggggaagcagauggaacggguuaggacuugagcaguguggacaguauggaggcuuuuaacugaauguugagguccuaucuuuguuaauggucaucaacuagaguugagauaaggaaagcugaggacaguguuagauagcuguucaguuaacaaguagggguagauaaugucuacuuuaaaagaaaaaagguuuuggcagguugacuucaaauucaguuuguaguccaggcuggccuucaccuugugauccuccugccugagccucgugaguacuggguucuauaggcauaaaacacuaugccuugcuacccaguuaaaauugaauguuauauuaaguaauaaaauuuuaguuuaaguaucccuuagcuaugguuuaaagcuaaacguacacaguacucauguuuaucugaguauuaggaacaauaauuuagguacuaccuagguggugguggaugugggacagagaaacugagccaggacauagacuuuuuuuuucuguugauaagaaaguaucugggggcuggagagauggcucaacagguaagagcacccgacugcucuuccgaagguccugaguucaaaucccagcaaccacaugguggcucacaaccacccauaacgagaucugacucucucuucuggugugucugaagacagcuacaguguacuuacauauaauaaauaaauaaaucuuuuaaaaaaaaaaaaagaaaguaucuggaagauugcuaggugaacgcaacaguguuaguggguacugugugagacauggaccuuacuaagaggggguuuuuaaaaagagaagaagaguuggaauuuuaccuucuuuagucuucuauuuaguguuucuaauuuacccucuacaacuuaacaguaaguuuguuuacuuuaaaaaguacuugagaguagguacuaagcauuugccagaucuccuccuccauucucuuguguucuucagccauuuuauagccauuuaguuaugucaccauccuaaaguuuugucugucugucagucugucagucuauuugucuauuuuuggugcaguggaggucaauaauuagcaucuguguguguguguguguguguguguguguguguuuugagacagggucuuaguauacaguuuggcugagcuggaacuguguguguguguguguguguuuugagacagggucucaguauacaguuuggcugagcuggaacuguguguguguguguguguguguguguguguguguguuuugagacagggucucaguauacaguuuggcugagcuggaacuguguguuuguguguguguguguguguguuuugagacagggucucaguauacaguuuggcugagcuggaacuguguguguguguguguguguuuugagacagggucucaguauacaguuuggcugagcuggaacuuguuauauagaccaggcuggccuugaacucaaaaauccaccucugcauccugaguguuaaaauuaaagauaugucacaaugccuagcuucuugccaguauuuuacuauaagaggauguuaugagacuuaaguaaaauuaaugacuuaaaaaauacugaggcaaaagguguaguggcacaggugugcaauaauagaccagcagagguagagagagaaauccugacuuuuaggcuauucugggguuaauauagcgaguucaagaccaguauuuaaaaaauccaaggugugcugggcggugguggcguacgccuuuaaucccagcacuugggaggcagaggcaggcggauuucugaguucgagggcagccuagucuacaaagugaguuccaggaaagccagagcuauacagagaaacccugacucgaaaaaacaauauauauauauucauauauuccaagguguaauaguauuauagcuuaucaguagagcauuucacuugucagccggcacaggaucuuggcuucaauucccagugcuauggaaaagacaaauucagguaacauuauguuuuuauauuugucuauugcuaguacaauaaaacuauaaagugucaacuuuguacauuauuuauuuaaaguuuauuauaaaaaucuauaaaauuaaaagcaagggacuagagagauggcucaggaguuagaaguguuuguuguucuuguagagaucugggcucaguuccugauggcucauaaccaucugcaacuauagaucuagaguauuagacaccuucuucuggccucugagggugccaggaauguccacgacacacagacauucauccaggcauacacuggaacacauacaucuuaaauggcuguauaugcacuagcauuaagccccauagguaucuuuacuuagcuuuuacccaguccaaagugguuucuuccacauugcuacccauuugcugcucgcucacgaccucuccauuguuuugaagugauccuguaugugauuucagcauagcuuagccuucccucaugcucaguuagcaguuagaaaacuucacuuauuuuuugugcucuguguguguguguguguacuugaguaaauauucuacuguggaggccagagguugacuucagguaccuuucucuauuggucuuuaccuuuuuaaggcagggucucugacugaaccuggugugcuguuuugguuagacuggcaggccauguaacccaccugucuuuccucuuuagugcuggaguuacaggcacaugucaccaugcacugcuuuucucaugagaguguuuggggucuaaaucagguuggcgugcuugcauggcaagcauuuuacccacugagccaucugccucaucucgguuuuccugauuguuuuuuaaugggaguaaguuauaccauggucagucaagcuguuugagcccuauugacuauguugaaggaugugcugguuguagaaagacuuagcccuuuuuuauagaucaggcuuugugagagucagagauaggaauauaugugaagauacuuuauaaacucuaaacucaaaacaaaaaugcucugcucauaacugggcaugauggugcucacuuucaaucccagcacucaagagguagaggcagcuggaucuuugugaauuugaggccagcguggucuacauagcaaguuccaggacagcuacaacuacauaagaagggguggagagaaagcucuacacauguaagauuucauuauuagaaguaaauggcaaauuccuguagacaugccaagaaguaaucuguguaaugaacauaaagcccacaguacugaaagcaccuugucaccauuacccgcagcauuuagacauuugaagcagccguugcucauuccacgucuggccugcuuuuucugcaugacuucucaaaguucacugacaucucccucccauauuuucaaguuucuuuuauacccuuggauuaauuuauguagacuugaacuuagauaaagcagauagaugggcucuuugugcuuuauguaagcauucuguugcuguuuagcaaugauuuuccacaucugaagaucauuuuguuucuguuagaauagaucagagaaaaauacaauaguuauguguuugggucaccuaguuuaugugcucuuuuggggaucgaggugcucugcacaugcucagugagugcugccaucauuaauauauauauauauauauaugauauauauauauuauauauacacagaagccaccaagggcucgcauuugucuucacgucuguagucacuuugaaauuuugagcauuuuaacucgucugccucuuuauuuauuguguguaguguauuuucuuuuaaaaauauccuuacaaguacugagcuuuggagggggagcaagaagucauggauguaggcccagugguuucuuuagaaaugcuaccauuaaauaaauucucuuguaacuuuaaaaggacuggcuuccuggauccacuagacacaguaugaguucugaaugcuuggaagugguuauaagucucccuagguaguuuuuuuuuauagcgcuggguuuauaaaccauuguuggauuuauauaugcaggauuccuagcuucuagguaguauuuauuuaacagacaauagcacaaccauauacaccauggcaacaaguucaaagacuggaugaacuuuaagaaccaacguuuuaaaaaacacuggaaggcuguuggaacagugacgaccaaaugaauuaaaguuucagggaugcaaagacauuuguagugggcugauuauggacacaugcugaaggaaaaagguaagccagagaugaacagaaucuuauuaaaaguguagcguagccgggcgugguggcgcacgccuuuaaucccagcacucgggagguagaggcaggcggauuucugaguucgaggacagucuggucuacaaagugaguuccaggacagccagggcuacacagagaaacccugucucgaaaaacaaaaaagaaaacaaaacaaaaaguguaguguaucccuggcccacuucaaccacugguuggauuacagagaucaucuuucucaacccuuuuugcuuaaugaagaaauaguaauucucacugucuaagaagauacauucuagaguuuuaagauuuuuuuauuugcaauauucagaguagaaccguuucuguggauguaaaaugaugaaaaauugugguccauacucaaaaaucaaaaguaaacuguagaaguggauucagaaaguuggcagcagacaaagacuuaaacaacaaaaacaacaaagaaacaaacaaaaacccugcaguguggggcuggagagauggcucaacaguugcugcucuuggagaggauccagauuugguucccaggaccugcuuugggcagcacacagcucccucucuguaacuuugauuccaggugauucagugucaucuucuggccucaaggacaccgguuacacacauguggacacuuacagauaagauuauuuuuaaagauaaaacaaagucauuugcugagaaaauaagggaaaagacaauugugaugacugggaauuucuuugaagagcuggaacccauagaagggaauagagaauaggucaucuaggaagcaguaacacaguuacgaguugcuuaaggucuuucauccguguucuuuuucuugacucugccucuucccugccccuuuuuauuuccuuuugggaaacaguucaguugaguacaggcuguuuaaacagauccacgaggucuuaggcuucugucgguuuuguuugcuguauuggugauagguaauggguggaucccugggccucucuggcuagccagucuagcuuaauuauguaucuccagguucuagugagagacucugucucaaaaagcaaggugggagcuguggaagauagagaaaugacucagcggaucugagcaguugcugugcaggcaugaggguuagaguguggagcccaaagcugaugaaaaggccaggguggccacauaugugccugcaacuguaacuucagcaugauaggggaguggagacaggggauuguuagguguaauuucuuucuauugcuuccugauucauauauucuugaccaucauuuuggaccucagcuguugugguaauccaaaccuuuaucacggagaauaugagucuguccugggugccugcugcauguguaugcauguaguauaguauacugcaaugcaguguaguguaguuuacugcaguauagugugguguaauauacagcagugcaguguacugcagugcagcauagugcaguguaguauacugcagugcauuguacuauagugugcugcaguguaguguagcauaauguacagcagugcaguguacugcaguacagaauagugcaguguaguauacugcaguguagucuacugaagugcaguguuguguaguguacugcaguguaguguaguguaguguagugauuuucauuaacuuuuggucuuacacaauaugagguuagagacauuucuuagauucaagguuccaaucuucuauguuuccuuuauaugguagcagugcuuuaucuccuugguuauggcauagguuacaccauuuaauggagugaccuuugacuauggauauagugcagugauucucaaccaggaguuuccagaggacaguugacaauaguuggacauauuuguaauagguacaaguuugagaaggugaggcuuaugguaucacguggguagaguggguagaggucagagaucugaccuggaucugacaguguuugggggagugaagaacagaauuaauccagucaaaaaugucaguacugcugagguugagcaagccugguuugguggcuaagcagugucaucuuucaguggguuaugcugguacuguuucuuucucaggaaucaaagcauguaaacuacagaugucuaaguuggaaguauuagaagccuaacugccaggagcguuuucagacugugugagaacagcuccugcucuucuuuauuuccaggcuucuguucucuggcuauggagaaagcacgauugauucagagaguaagugcgcucuguuagauaggagcgccagcccuguggaauuaucucucaacucccauuuccuacuaggacacuugcuuuugggggauggcccaugccagaaaccaggucaucuuaaguccagagcccagcugcauuccuucucguaggaagggaguuuguucaggggcacuguuagcagugcguuuagucacaaacagugugucuccgaaggccuuuaaugaugcuggcagaagcauuucaggaggagaugcaaagcugucuagaacauguuuauaugaacauauauaugcuaguucuauguguauguauacauaugacuuauuuucucccuaaaaguauguuacugccgggcgugguggcgcacaccuuuaauccuaacacuugggagguagaggcagaggcaggcagauuucugaguucgaggccagccuggucuacaaagugagguccaggacagccagggauacccagagaaacccugucucgaaaaaaccaaaaaaaaaaaaaaaaaaaaaaaguauguuacuguccacuguaauuaguaguuaacuuucauuaauauuuugugaacauuuuauuuuuuaauuuaggggugggagcaagaccuggcugguuccucgcccauagucucagcacucaagaugcugaguucuggaggguuggacuacauaguaacacccugucucaaaaaaagaaagaaaaacaaaguaguuauaaguuauagacuuuaaaaaaaguuaaauugcccuaugaacaacauagagcagagcuuccaaaaucuuuucuccuuguuaacauggccagagaaaaauuuacacagcccauucauauauaugaaugaaacauuuauuccuaguaaauaaaaaaauuauuuuaaaaacaauucuuuggcauacaugugauuuuaccauuuauuuaacaugaaugcaaggggcuggggagauggcuuagugguaagagcacuggcuguucuucuguuggaccuggguucaauucccaguauccauauagcagcucacaacugucuggaacucuaguuccaggguaucugacacucucacacagacaaacaugcaggcaaaacaccaaucugacacucucacacagacauacaugcuggcaaaucaccaaugcacauaaaaauaauaaaacuaaaaucauuuaaaaugaaugcaaauaugcaugauagugcaauggauguguuuauuuuuauaucaaaguaaaccuuggaguauuugauaagcagagcauagaacaucuucauuguguuucagagguaauugacauuuugauuuauaauugucauguucaaaaugcugauuugcauaaacacauauguaguucaaaaugacagagauauguuuagggucauuucagaauuguuggaaauucucuuguaauuccaaauggaauuuuguaugugugcgcauguguguguguguguacguguaugugugcauguaugugugggugugugucuguguguguguguggggauguguguggguuaaaacagcaacucaaagaaaaguuguauguuagaggaccaaugucagguaucuuccucaauugcucucagccuuaauccuugagauagggucucuggcuuaaacuuguaguugaucauuuugaguagcuuggcuguaguaagccucagugguccaccuucuucucccuccccaacacugggauuuuuagauguaugcuguggcuggugggauagaauucuauuccuuacauuuucauggcaaguguuuuaccaacugagccauccguagcucacuccaagaauaauuuuuaaagucaaacauucuaauauaauucaauccaaagauaugcugauuugauauuugcaugaugagggaucaugguagaaaaacauugcaagccauuguuuuuuauaauuaaaccauugcguuucuauaagaacagaaaacuuuguauguauaaugaaaagauuacacuuaauaaugcacaguaaucuagauccuguccaagguauucuaaguguuuggcaugauggcaugugcacuuuguuucaagacugcagugaaguuccaugaugcaacaggagugaguaccaccaauucauuuuugauuguugcaccugagaaaauuuuccuuauugccagcauuuucaugauccccaugacucauaguugaagaauuagucgggagcuacaguaaguguaaacuagugaauuuugaauuauauuuuacccauacaaauuuaucuuuguuaccuuucuccuuccuuccuuccuuccuuccuuccuuccuuccuuccuuccuuccuuccuuccuuccuuccuuccucccucccucccucccucccucccucccucccucucuuucuuucuuucuuucuuucuuucuuucuuuuuuugagauaggguuucucuguauagcccuggcuguccuggaacucacuuuguagcccaggcuggccucgaacucagaaauccgccugccucugccucccaagugcugggauuaaaggugugggccaccaccgccaggcucuuuguuaccuuuccauuguuucaaauuuuguagaccucuaccuguuaaaguccauuguuaugaauuacauuguugauacuauuauagcuugccaaaucuaauuuuuuguacuuauauuuauuagccuguguauauguuaccauguaugugugugcuugaugaaugcaaaggucagaaaagggcacugaauacuggaacuggaauuauaaaagaguugugagcugucaugugggugcuuggaucugaacccaaguccucuguaagaacaguaacugcucuuaacagcugagccgucucucuaggcccuacccuaccaaaucucaaaaggcuuacuuuuuuauuauuaguccuagucauuuucaacugaagaguuguguauguauuucagaagaauaauauaaauaauugggcucugagcaucuagcuaguuagaaccuauccaccuugccugcuaaaucacaguggaaaucuugagagaguuggaacagaagaacuuaaaacuauaaaguucucuucaaggaucuauuaagacauaaccacuuauaaaaccguacuucucauuaguguuagggaauuuucauuuuagaacucuaaagccauguuugcuaauuaucuucucuacuaaacauaguccagaaagacaaagauuugugcuccccucuauuguauauguggcaugcacauagaagaaacuaaaaauuuacugaaugaauuuaugagaaaugauuuucugugcuuuuaagagaacugucuggcacaugucaagucuuaagagauuaaaaaauggcucuuaauuuuuuagaguuuauauuuuuauuuacuguuuuguauuaauuauuauaacaugugccauaacgugcuaguggaggucagaagacagcuauggaaguuggucuuuuggcuuccaacaugugaucccuggauugaacucagguucucagacaugcacaguagcacauucucccacugaaccaucuugcuggcccuagacuggcccuuucccccauucucaucuuguucuaaucaaaucaucauaaauacagucauuugacauuuaaaauaaauaaaaguuuguaucaacacuuguagacuagaauuugguugaauucuaaaaaaaaaugucuuucaaauaugguacaucuguuaacuaauaugaacugguuuuuacuauuucaaacuaaguaaaaauaauuuuauucaguguuauauguuuuuaaucuacauguugucuuaugaauaaauguuucuaaaugcaguuugggaacuagaauuugaggggaacuuuuuucuuuagcuuucuggauaaucacaaaauaaaguggauucuuaaaagugucaguggaccugguaagguggaaguguuccagccgcagcucagauaguggaaacuuucugcgaacaauuuauuuuauuuuccuuauccuacagaaaucacucuaggucugaagaaugcaaguuuuuaauagugcccuauuaaucucgcuagacacagcacaauucuagcuuagaugauuugugacaggcagucaacuguugaaagaguuugacuuuauugugugugugacagagacccauugaaaggcuuuaaguaugaaugccauggucacauguuuuaaacaguuucuuuaugguuauacuggagauggauuugaggagacaguauuaaagacaaugagaauaagaaauuguaaugggaauggaguucugaaugccauggucacauguuuuaaacaguuucuuuaugguuauacuggagauggauuugaggagacaguauuaaagacaaugagaauaagaaauuguaaugggaauggaguucugaaguagggaauugaauguaggaauuuagagagccuaaaugugagauuuguguaggagaugauauuggaaggcuuagaugauuaaauaaggaaaggaagaaacuaaugggaguaagcuaguugaaaauugggaaaaguugugaaugacaggacuuaaaaaaaaaguuggugggggagcgugugggcgacuuuugggauagcauuggaaauguaaaugaaauaaauacccaauuaaaaaaacauaaaaaaaagaaaaaaaaaguugugguggugcauguucguauaucugcagauguguacaugugcacuuaugugugagagcagaggucaaccuaagguaccguuccucaggaacuauacaccuuuuacuuuauuuauuuauuuuacuuauucuuugguaguuuuauaccugaauccuccaacucaugccuaccuucauguccugccuuuaaccuccugccugccugccugccugccugccuuucuauccccacugagucuaauuaguacugccugugugugauguaagaccaaacauuggcuuauagacaacauaccauggaccauacuccaaaagaaaauucucccucucuaucuuguuaguccugguugguuuuuaauuauuaccauuuguuuguuuguuuguuugcuuuguucuguuuuugucaccuugacacaaacuagauagcuggaagaaccuuaguugagaugccccuccaucagauggccucuaggcaagcgugguuaguugauaugggaggauccagcccagugugguuggcuccaccccugggcaggugguucugaauuguauaagaaagcaggcugagcaagcagugagaagcaagccuguaagcagcuuuccucuaugguuuuugcuucaguuccugccuucagguuccugcuuugaguuccugccuuuacuuuccucagugauggaguaugaccugagaguuguaaaaugaaagaaauucuuccccaaguugcuuuuguaauuguguuuuaucauagcauuagaaaucuaauuaagacauuugguuuuucucaacugggucucucacugggacccagacugguagauugggauaggccagugagcccuugaaucuugcuugucuccaccuccgcagugcuaggaugcaaauguacuccuugggcuagagacccuuucccuuugauuauggugcuggagauggaccucagaaccuugcucaugcuaggcaaguguucuuucauuaauccacaucccaacuuucaacuuguucagaaagagucuugauaauugugcguuguuuuauuuggcuugacuacauauuaacuucaguucacaauuucauccuuuccucuucagucguugaauuguuugcuuauggucucuagcaaugguccuuucuuaacuugugggucaugaccacuuuggcaaaccucugucuccaaaaauauuuacaaugcaguucauacuauuauauuuaugaaguagcagugaauguaauuuuaugguugaaggucaccacaacaugaggaacuguauuuaaagggccacaacauuagaaagguugagaaccacugguuuagaggaauauuuauuuccuuuucaauaguuucacuugguuaguuuucagguaaguuaaggaugaaugucuuauauaaaacauguuuucugagauagggauguagcuuaguaguagagugcaaggguuugauuuugaucucuugcaccagaagacagacaggcaggcagguaggcaggcaggcaggcagguuaggcaagaaggcaggcaagaaggcacacgcgcacacacacacacacacacacacacacacacacacacacacacgguuuauuuuuuaugcuuugacuuugagucauguccuugaaguugaagauggccuugaguuaacuguguauuggggauuccugugacucccgauucucccgucugugcucuucucaaagauuacaggcguaugcuacuguuagagaaagaauaaaucaucugugcacugagcuuagugaggugaaggagaggcuucuuaauagcacuuggcugacucuggcuaaugcccaaagaccggccagccucaaauagaagaugucacuagcauggacacauuaggcuuaugcauuccacacacucauccuuaaguccuuuucaggucuagccccagguuacacuuggaacggaugagagauauugucagacucguaaguacaguagugcuguuuuuuuauuuuauuauuauuauuauuuuauuuuauuuuuuuaguagugcuguuuuuaaaaauaguuguuacccagauucuucugacccaccugcagaauuauguuuucucugugaagcggacaggggacucgguggcugaccaggacuuaagauagcugugaucuugagcugcuccccagagcugucccuuagaauuauguucuuugauacagggaugggccuaauggcuguuuguaagucagaauugucucuuuguuaugggaauggagccucuuuggagaucaaucuuggugaauaaacuucgacagaaacauucuuagcaaccccaaacuucaauuacaguacaaaguuuucuuucucacauugucuaacaagucugguggaguacaccaaucuuccaguccugcuggaggcagcaguccuuuagcuaaauucuuuguucuguaacauaauauuuccuaagcaaguuuauuaguaauuuuuuuuuucaaaacagugauuuuucucugucgcccgggcuguccuggaacuugcucuuguagaccaggcuagccucaaacucagacaucuaccugccucugccuccagagugcugggauuaaaggcgugcugggucacuauguauauguauaucuuuuuaaauggguauggggcacauaaguucucaguauuuccuggcuccuaacuuguaauccaccuguuucaguucuuuccaguguuaggaauauagguauuuccauggaucccagcucucaacaccucucucuccccguccauugacucuaaugguauuauuuuagcauugggguguuaaaaguagacuaguuaaaaauagacugagugugaaguugaaagggcuuccagacucaggccuggaaguuaaacuuguucuggcucuguucuccgugauuauuccaaguuuauuuuaaucugcaucuugccguuuuaugaaugaaguucucuuucauucaguccaauaaagaaaauggccauuaacacacugcuaaauagcuccagcuucugguuugaacuaaguuauaaaaauuagcauaguggcaggugcuucaacuguuauauaugccauguuacagguaacacauagcaucuuuguuaaucagaaccuacuuucucggcuacugugaaggagguaaaaucuagaugagaaucuucacuguugccuuuuguuauuuuagcuuauuaaaauugauaaauugugaacuuugccaguguauuuuauuaugucuuaaaaauuugaaucccaccgggugguggugguacaugccuuuaaucccagcacuagggaggcagaggcagguggauuucugaguuugaggccagccuggucuacagagugaguuucaggacagccagggcuacacagagaaacccugucuugaaaaaccaaaaaaagauuuuuuuuuuaaucacacguguuagcuucauaaacauugaacugucccuguuugguuuuguggugaauuaacaaagcacacuuauaaaucugauuaaaugugguuagccuuuuagucauucuuuuuaaaaaguucucuuccagccuuccucucugcucuuuccugcccgugugggagguuagaggugaccucacugagucccccacgucauuugugagguaggauguuuaccugacuaacagucgagcccuaggcguccuccugucccugcuucccaagugcugggauucucggugugugcuacuuuacucagcucuuuguaaagauucuggaagaagcaacucaggucucucgggcacugcacuaacggagccccuccccagcucuccgucuuccuuuuaaccucagugacagacagggugucuuauguuaaugugaccagaagaggaaugauuuugaaauuuguuggcuggcuuuuuaaauaauaauauuaggaaaauauuuguuucugagugaagauaaugggauaauuaacuaaacugguaguuuuggaggcaguuguuuuggaaaguaucuuugucuauuuauuuaacgugcuguaguaaauuuaguacaauaggaaguagaaauucauccaucacacuccugguggcugagaagggugaagaguaagacacagcagguuuggugucaaagggcuugugccuccuaaaugucccuucuuguccuuucuucacacaggccucauuuguauuuuccaugguucuggagauuaagccccggacuggccuuuacauacgcuaggggagccuuaucccacugagcacaucuuuagcucucuuuuauuuaugucuuuuugagguaauguugcuuaggcuggcuucuugaacuugcuguguagcccaagcuggccuuuaauucacaguuccucuucguucugcaccuccaugugcuaaaauucgaggcaugggccaucauguucauuucacuugggccucuuaggacauaaucauucuuugagggcucuauaaccugauuuccauucuuguaaaaccuucaaugagggcuaaguuucaacauaugaauagggugucuuuguuauauguagguagaguauguuugcucuauuccaguagcaccauaugucugaagucuagagucguuucauucucaucuaagugagcauaggcgagagucaagaugcuguucaucuugaggcaaguugcccagcugugaauuugugaaauuaaguuaucugcuccuaagaugcaaguuuggggcaggcagaagauaagcauuccuauuccuaaaaggugagaaagaggaaagaagaaagggauuguagguguugcauaaggaaauccaaagcccagcaguguaaaauaguguaucuuaaggcucaugaauaacgaguuuuacuccacaucuugccuuucacacccccugguguagaauuugagcuuuuaaaacuuuggcagucuugguguuaauagcucugcugggugggugcagccuguguggcauggguuggaaugcuggucuguggcucuuccaggcuagagucaaaaguuuggccacccaaacccuucuuuugacaggaucuuuuccaagcuauggguuucugagccugacaggaggaggaguacccauaacuuccugaaugccuuuguggcuauuucuguuaccuugauggcuucaucucuggccccuacgaaucuguuaaaaaaaucgucauagaucugugggaguugcuuucccagacauacauucucauucuuuacaucauggccaggaagaagcucccaaauaacauguuugcuuuccuuuugauuguaaauuucaucuuuaagucacuuuucuauuuggauuuacucggaugcugucaagagaagccaugcugugguuccugcuuuuguuuacauaguucaucagccagacaucuaauuuuaccacucaugaauccuauuuccuguaaaacgucaggauaggacucaguucauaauggcucuuuaccacuuuuuauuuuuauuuucauugcuguauguggaacccggauccucgagcaugcuggacuguuuucugcuauugcacaguaguccuugcuucucuguaacaggcucuguguucuucccguuggcagugacauguuccucauuucugcgaccucaucggaaugaccuuuacuguucauauuucuaucaacauuucauucaaaagcaucuguguaaucucugagaagacagaggcagucuguguagugagcuucugugcggucgcuuuagaaucauccagaaggcucuguucauagcgacaaggcuuuuuuuacacacaugucuagauucuuccaucuuguaccuauuacccaguuccaaaguugcuucugcaguuagauuuauguuauaacaacaacucuacucuuugguccuagcuucugucuuuguuugggcuacuauaacaacauaugcagaugugaaggcuggucuguauagguggugcuuucuugggcuacuauaacaacauaugcagaugugaaggcuggucuguauagguggugcuuucuugguaccuuacccugauagaccaguugucuacauuguuuuuguuauuuuggggaauauuuuuugagauuggcuuuccauauuuuacucagagugacuucaaacucaagcuuauccuuuucccacacccuggagagcuaggauuauaggcucagcaccacagugcuuuucuacuucuauauauuuucauuuauucucccugccuuuucuuuguccauacauacauauaauuggggggacaugaagagaaacauuugaugcuuaguugcagucauagugcccugucccaggaugccucaggguaccuuuaagaguaagagcuaacaucuuuaagugguaauauaaauuuuaacucuaggacacuuaacaucaaaauaguacuaaacuauacuccaugccuauauuuaaaguuugcuaguaguaguugcucaaauaauucauguauauuuuuuuguuugcuuguaauuuuuaugauugcucaacuguaucuacaucuacuugcaugccagaagagggcaucagauacccauuacagaugguugugagccaccauaugguugcugggaauugaacuuaggaccucugacagagcagccagugcucuuaauugcugagccaucucuucagcccccaauucauguauuaauaauuuucaaaguggugcuuuccuuaucuucuuuggacuuaaguguagggaguuuucaauacuuuaaucuucguaaauuguauauuguguuuuguaugcugaggcauguauaucucaugucuaacucauuugaguugcuugguuuucaguacauauuuacaagucuuuucuagaaauauauuuuaaaaauguuuuuggaaaauauuguaaaauuuaagcucauacagauauauuauagaaugauauggaaaaauuucauccuauggaaguauaccauaggauuuaaagauuauuuuaccucucaaauauagagauaacugguccaaauuuguucccauauacauaauaaaguggcaugccucuuuauuggguugauguuuuggggaaaaucaccacagcucuauaauaagaaaacuacccauaacuagugacgguuauaauaaugaaaaugucaggaguucaugccugucaucccagcacuuggaggauagagacagguagcucucccggucaaccgaguagucuaaggccagccuggguuacgugagcucguuaaaaaaaaaaaaaaaaagauuacaaucccaaaacaauaauaguaaaagggguaguuccauaugcauuuuuuuauuuuuugauaaccaaaaguauuugucuaaauuguagaucaaauuuuguagcgaguaccccuuccccuuucuguucaguuagagaauaguaauguaugcucaaaauaguaauauuugauuuaguugaugugaaucaaaaauuggggaguuaauguuuuuaaaaacugacauucacuuuuaauaaguuguuagaagcuacauucauguuuguaugguacaaguaacuuccaugugggguggcauuugcuuuugagaaaaauuguuuuucuuuggggacagaguaucucucuaguuuaacuucuggagggugucuuaguuacuguucuuucuccucucugugagaaaucaugagagagggcaucagauggucccuuagaguguguuacagacaguugcaagccaccacauggaugcuggggagggagccuggggccucuggaagagcagcuggagcucuuaccugcugagcaucucuccagacuagcauucuucuucucagugagugugcaaccucugcuaauggaauggugguguucacauucagggcgggucuuccugccaccucaaaccccucugagacccucccacauguuggaaaggguucuguagcuuucagucuugucagcuugacuauaaagauugacuaucacagacccguucauuauuuugaaaaugggucugacugucuaacacacccugucuggaacuuaauauuuuccugccuuagccuauucaaugcugggauuauggguguguuccaccuaaccuagguaauaaaaguauuuuuauuuuauaaaauguuguacauaaaguucaagguuucuuuguacccucugauccccuuuauuccucucauuuuaaccacuggccugaaguuuauuuguauucugugucuccagccagguauggaaguacauaccuuuuuuuugggcggggggcagggguucagggaacuuuuauugaugguauucaagagaguaggaugggggucuaggaugaaaaaugugagggaggagaugcuuacugcugggggucgaguuaggaaagggacuccucugcaacugagagccucucucuugcucucaguguccuugcuggggugggugguccaagguuucuuacuccuuggaggccauggaggccaugagguccaccaccuuguugcuguagcuguguucguugccauaccagaagaugagcuuuacaaaguugucauugagaacaaugccagccacagcaucaaagguggaagagagggaguugcuguugaaguugcaggagacaaccugguccucaguguagcccaggaugcccuucagugggcucucagaugccugcucuaccaccuuccugauguuaucauacuugucagguuucuccaggcagcaugucagauccauaauggauacauugggaguaggaacacagaaggccaugccagugaguuucucucucguucagcuuugggaugaccuuacccacagccucggaagcaucaguggaugcagggaugauauucugggcagccccagggccaucaugccacagcuuuccagaggggccauccacagucuuuugaguugcagugauggcaugaacuguggacacgagcucuuccacgaugccaaaguuguuaugaaugaccuuggccaggggggcuaagcaguugguggugcaggaugcauugcugacaaucuugagugaguugucacauuucucgugguucagacccaucacagacaugggggcacuggcagaagggguagagauaaugacuguuuuggccccacccuucauguggccuucuccaugguggugaagacccaguagacucuacuacauacucagcaccagcaucauuccauuugauguuagugggaucucgcuccuggaagauggugaugggcuucccguugaugacugccucccauucucagccuugacuguccuguugauuuugccuuggguggagucauacauguaguugaggucaaugaaggggccauugauggcaacagucuccacuuuagaaggcagcccugguaacuuggcguccaguauagccaaaucuauucacaccgaccuucaccaacuugucuaugggacaagacugacacagcugucucuggaacagggaggaguagagagccaaaaguguauaccuuuaauaccagcacacguggcagaggcgggugauuucuuugaguuuuuuuuuuuuuuaagauuuauuuuuuauuuuauguauaugaguacaccauuacucucuucagauacaccagaagagggcaucagaucccauuacagaugguugugagccaccaugugguugcugggaauugaacucgggaccucuggaagagcaaccagugcucuuaaccgcugagcuaucuuuccagccccauuuuuuuuuuuuuuuugaguuuaaggccagccugggcuacauaguaagaccuguuuuaaacacacacaaugaaaaaaaauuuuuauauggaaaauauauggggaauauuuuuuuaaaugcuuuaaaaccuuuuuguauguucuuguuuuuaggcauagauacucacuugauuuaaauuuagcuguuuuaauaaugucaguuuaucuauuacaugaauucagacagaauccaaacucacugcgguccuccugccucagcucccaaaugcugguauuguagagcaugugcuucuauguucagcaaaucaauuuuuguuuucaacuacagaggaucaguuacacuucuacuguggaggaucauaguauacaagaguauauaaugggguggagagauggcucagugcuuaagaccauuugcugcuccuucagaggacccagguuugagugcauccacaugggagcuuacaaccaccuguaaccuuuucuggccuccgaggacuccaggcaugcaccuugugcauagguuuacguauagguaaaacacacauacacauaaaaaaaaucuuguggggcugaagacauggcuuagugguuaagaguacuagcuguucuuuuagaagacccaguacccacauaaagacuuaacacugaacuauaacucuagcucccggggauccagugcccucuuuugguuuccaugggcauugcaugcacgaggugcacagacagaaacuuguacacuuaagaauaaauacauuuuuuaauaaaagauuaugugaaguguguuuguacaguucauagcuaaacaguaauacuguggacucuuguauugagguuagggaagaacauugcuggugucuucaacuuguugauaaccuaaaucacacugguuuucuuagcauuuacuguuauccugaaucguguuuagaaaauuucccugcuuucuagugagucucuccaaacacguuuguuuacuugucuucgacauuuuuuaaugauacagcaauacuauagguguugucuuucacaugcauuuggagugucauuucuguucuuuguggaguccauuacugcuacagauuauuucauacuucacuauuuauacuauugauaauaaacaguuaguacauacacucucuccuucccuucuuuuuuucugguagugcugggggucaaaaccuaaggacuugcuuguuccuucuaggcaaguguuccaucucugggcuacaccccguguugcauguuuuugcuguaacuaauaacgcugcuucugaccauuggaaauauaugucuaguaguagaccugcucagcguuagcguauaugagaauguucaguuuuaccagaaaaugccacauugucuuuaaaagucuuugauccccagugcugcccccuucagcaugucuuccuguugcucacuguccuuggguuguguauguaacauuuguaucuacccgcuuagugauacaucacuucuuccuagcagauaguaaaagauuacuuuaaccauauuccauauuugaaauuucauuauuuuuuuauuuuuaaguuguauuuuauuauuucacaugaguauguugcuuguauguuuguauguauguauguauguauguauauguauauguauauguacauguacauguacaauguauagcaccugucgaggucagaagagggcauuagaucacuuaggacaaaaauuauagacuuauaaugugaauuauauagcugucaugugaaugcuggaaauuagauccugguccucuuguaagagcagcaagugcucuuaaacugcugagcuaauuaucuggcucccaguuuuucuuucuuucuuucuuuuuuuuuuuuuuaauuauaaauguguguguguguguguuuacacagaugcaggugccuguagaggccaaaaguggaaguuggauccucugaggcuguagucauggcaguuuguuagcugccugacauaggugcuggaaacugaacucagguccucuaaagacuaagcacauguuuguaaccacugagacaucuuuuuugccaggcuuuuuauuauuuuucaauuuuagguguuuucguuuucugguuaugauuuuccuuuuuauccaggauguuuuauugucuuugagauguuuuccuagcuaucuuuauuuguguguuuguuuccgguuuucaagacaggguuucucuauguaguccuggcuuuccugggaaaaacucuaggccaggcuggcccuaaacccagagaucugccugccucugccucucuaguaugaggauuaaagguguucaccaccagugucugguuuuauuuauuaauuuauacuucaguguugaagaucaagccauucaaaauuucagcauaguuagggaggaacuugagaggccccacugcugacaagggagcuauuuguugguaguggauagcuacugugggagggaaagaccaucgaagguguggccaguguugguugcccguguuucaauagcucuauagcuaugcacauauggucugcauuaaauggacuuaguagacuauuuuuuaaaaaagggcuggcgagauggcucagagguuuuuuuaaaaaaaagucauaaaguugggaggcagacauguggagaucuggggcauuggagggggagaaauggggcuggacauaaucauauuucauuguaaacacaugaaauucucaauaaaaauuaaauaaaaguauuucuauuuuaauuguauugucagcaaauaugguuuucauguuacuaguacuuucaaauuugaccuuaacuuuuuauaguugaauauuuuauuacuuacugcuguugcaaaaauuuucaaaauguaguacauguuagaaaaguacuguauccugggcuuauuccugauccucuuuagcuuuuacauuuuauuuauuuuuauuuauuuauuuauuuauuuauuuauuuauuauuuauuuauuuauuggguuuuuggagacaggguuucucuguguagccuuggcuguccuggaacucacucuguagacuaggcuggccuugaacucauaaaucugccugccucugccucccaagugcugggauuaaaggugugcgccaucacugcccggcuauuuuguuauuuuuaaaagaagauuuauuuuuaauaaauuuauaccuaguagcacaauuacagauaguugugaacugccuuguggggccuagggauugaaccuagguccuuuggaggaguagucaguacucuaaacugcuaagccaugucuccaacuguacuuuuuacuuuguaauuuugaagcagauucucucugaguuucuugggcuugcuuuacacucucuuacacaggcuagcauuugagucaugagucugagccuccuuaguagugggauuacagguucaugccagguucaguuuaaaaaacaacagacaauuuuaauaucucaaaguucugcuuuucuaaaauccaugagcggcuuuaugauaauagcuuuugcucacuguuuuucaaaagauugcagaugagcagcagucaucuaaagauuugacauguacuaauuauucacuuccagugacaucauuuacauagcuauagggggguggcuucaauaucuauaucuauaucuauaucuaucuaucuaucuaucuaucuaucuacuucaauaucuauaucuaucuaucuaucuaucuaucuaucuauccauccauccauccaaucauccaucuaucuaucuaucuaucuaucuaucuaucuaucuauccauccauccauccauccauccauccauccauccaaucacccauccaucuaucuaucuaucuaucuaucuaucuaucuaucuaucuaucuaucugucuaucuaaucuaaccuaucuaauccaucuaaucuauuucuagcugcuugcaaaagggcucaguuccuguugcuaggccuucuugaacacaugacaauugacauuguggaaggugaauguuuugagagaaucagaagcuaugucuuuuuuaaagacccuuggaaguugauacacccucccuucugcuaucuuauauuaauuacccauagagaacaguuuucauauagggugcaagaacuacacaaagauacuacaacauuggaauaauuaugggccaucuuggagucuagauagucaugaaguucauuuuauaaaguuuuuauauguucuugaaaauaauguguaaucucugguucuuggguauaauucuuauguguuguuuuggucaaguucugcauucuaauuuuucccccuuacuacaauguauaacugaaagaaauauauguuaggcagucuugcacugaauuugaugugauuuaauuuuuuuacuuuuauuguguguuuguguacaugugguaugugcacacaugcuuauaccaaugcaugugcacacacauagaccagaggaggguguugaauguccugcucugucacugcuuuauucuuuugacacaggguuucucacugaacuuagagcuagacugguggccagcaaaccccaacaguucuccauucuuuauaccccuaacaucauugagguugcagguacuugcacagccacgcccagcuuguuaccugaguaccagcagcagaacucaggcucccaugcuuguauagcagccaucucucuaggccaaaguaguagauaugccaguuuuguuauguguauauaauuaggugcucagaagucagaaucucaugcugugaggucaucuuuuucagguccucccucccucccccucccuccccucccucccccucccucccccucccuccccucccucccccucccucccucugccuugcacguguuggacaagccaucugcuauaugcauuccacuucuuguugaguuucuuuaguaucugcugggucuucuuccauucacugaccaugaaucuuuguguauguuugugguuuaaguuuuucuuauaaauaguacaauggagauaguuugacuuuuucuuccaacuggaauguuuauuuuauuuacauuaaucaugauuacuggcauauuugaacuuauuucuguuacuuuauaagacuuuuauuuuccuuuuuuucacucuacccccuucuugaauuugacuuuuuguuuuguuuuauuuuauuuuauuuuauuuuauguauaugaguacacuguaguuguuugccuucagacacccuagaaggcggcaccggaccccauuacaaauaguugugagccaccauguugcuggaaauugaauucaagaucucuggaagagcagucaaugcuuuuaaccacugagccauuacuccagccugaaucugacuuuucuuuuaggcuuauuuuucuucugcuugaagcauguucuuuagaacuauuuuaaauaagggucuauugcaguaauugcucuuuuucuuuucuuaaaaauaucuuaauuuccuccucauuucugagucauaauuucaccaguauguagaaaucuggguaguuguuugccuccuaagucuauuaaagauacccuuuucuuacuuuucugcuguuguugagaacucaguugucauuauaauugccauuacucuauaggugguauuuuucuuucuggcugcuuuaaagucuuuuucuuuuucaccuuuuguauuuucccucucaccaaagguaauuauguugaguaaugaaugcauuaauugacuugauuauugucauaguuacuuuucuauugcugugauaaaacacagugacgaaagcaauuuauaaaaaacuguucaggggugggggcaguggggguggcggggauggcggagauaucagcaguggaguugguggcagcacacgccuuuaacuccuagcacuugggagacagaggcagggggaucucuaugcauucaaggcuagcuuggguuacaaagugaguuccaggacagucaggacuacccagagaaacccuguuucaaaaaaaccaaaagaaaaaagaaaaaaaaguuuaguuuggcuuaugcuuucagaggguuagaauccaugaugucggagcaaaggaauagcugagagaucacaucuugacccauaaccaugaggcagagagagagagagagagagagagagagagagagagagagagagagagagagagcgcgcgcgcgcgcgcgagagcgagcgagcuagcagcacugggaaucucaaagagucuuuuugaaaucggaaagaccaccccaagugaugcauuuagacaguucuaccagcugggaaccaaguguucagauauaugaaccauggggauaauuuucauucagacuaucacaauugugguuaugauuucacaggauauugaaaucuuguuauguaaguuaaauauauaaaauuuuauuugcuaauuaugccuaagugggaaaacaaauguaaaagucugcuuuuaaaugagggauaauugggaguucuuguacaugcgccuuucuguagggcagguugguagggagcucacuucaugguuguugacccuccagauguguuucaguggagauccacuuuaucuggacgaauauugccucacugguugccuggguaguaaugcuugauuaaaggauuaagccaagagccugguagguuuauauuauggagauugucaccuauuaaggaaguaagaggauuaucauggaaagguuauuuuauaguucagguuuuaaaauauaggcaaaggaaauggucauugugucuuuaccucugaauucggugaacugucuguacuuugucuguagccuagcaggggcaaccuguugcuccuggaccacagucucaggcacauugcuccagguaauaaaaggugguuguuaaaggcaauuggaaaggcaguguaauguuacugguuuauucuuucauucaacaaacauuuauuaauugccuuuauaaaaccuccuaaucaaaggauaaaacgacuuuugagaaagaugucuuucuugcuaccauggaacuuaaaaugcaagagugauaugcauuaaacaguuuaucauguggcuaauuauauuuguuacaagaaucauaaacauccuggggauguggcuuaauugauauagagaacuuguuuagccuccaugaaguuauagacaucuguagcacuguaugaaacugggcauggugguacaugcuggcaacuuuaguaauuagggaguagaggcagaaggaucagaaguucagggucaucuuugauugcaauagagaguuugagucuaggguagaugagacacuagagaaauagagaaaaauuuuuuugagcaaaauaauuguauuugagaguuuuuuuuuuuuuuuucuuucauggcuuucuuuucagugagcguauauuacuuucacaauuggggaaaagugaauuaaacuucaaaaauacgcuauauuacaaauaucuuuagcuauaguagaauauagagauaucuuuggacauaauagaauauaaagggcuuagguugccugaggaaaaaggaaaaagaagcaccuuugaauuaucucuauuuaaagcaaaauaugaucuacuauaagaucucaacaaauagggaguuauuuagaagaaagcauaacauuaaacaaagaacugugaacaaugaguaguuuguuucuauuuucacucagaaauucuuugaaaggucacagacuaaaaugugugcuucuguguacauucuaaugaguuucuaaaaggccucucagacuguaauggaaguuaggggugauguuacauuucacuuaguguacacacaggaagaaagcaaaggaaaaauagcucaugaggaggaagaacaccccguaugucaucuuuagguauuaggaaauacacacauuaaggaggugucuucucugcuggagcacaggcugacugaugaaaagcaccggcugcuuuuccagacgacccguuugauuccagcagccacauggcaggcaggcagcucgugaccaucuuuaaacuccaguucugggacaucugacuuccucucuuuuggccuccaagggcauuguauguacauggcacauagacacacacauuauuauuaauauuuuuuaaaaaauuaaacuacccuugacuauuguagcuuauauuaagcacaucucccagaagagucuguguuauugguuacguauuacauauguaauaguccuuuauguaguacucaaugaacuuaaaauuaugaaguuuguuuuuauuuuaaugucauuuuaagucuauaauuggcaaucaaacaaagcuauuauuccuuuagcaaaguuaaaugaaaaaggugagcuaacugcagauuguuaagccaggaauccaugauacaggauauggcuaagcuaauaauauaugaaucacuaaaguugggcagaguggauggauaagccugaaauuuaauccugagcucauaaaacagguauuacauaauuaccauuuuuaaaaccauacagauauaaaccaucuguaggcaaagguauuugcauggagccaaacuaguuuugccaagaagcgaauuuccuugaauucacuuuuccuugaaagcuugaguuuuaguuuauucuuuuccugcuauucugaauagccaccuaaguuuucaugcacagaagcauuaagucuuuuuuuuucuuuaaagauuuauuuuauuuauaugaguacacuguagcugucuucagacacaccagaagaggaaucggaucccauuacagaugguucugagcuaucaugugguugcugggauuugaacucaggaccucuugaagagcaaccagugcucuuaaccacugagccaucucuccagcccagaagcgucuuauagaaccuauuuauacucacuucaccccuauuuaugcaaccacuauugaaacuccaaaagcuaauucccaaaugucuuuucagcaggagcccgcuucuuaccagccuaaacuacaguuguauuauuugcacagaaaaugcuggcuccauuauuuccuucucucccucuguaaaguucaaaagccauuagguaaaacagagcaaguaggcaucucuguacaugcuuggguaaaagagccugaucagagugaaaaaggcauugcuguggaggagagcagcauaagacagaaagaguguccacaauugccaggcuaggcagagucagacaaggagagacuacucuguagaggguggccagacagaacauuaguucacacagggaggaggggacaauaggccacaggaugacaaggccccagugggauaaggauagaauuuauaagaaagauaucccuagauaggugucaguaccugagugggccuagaaggugcuggugggcuguggccagagcaggcguguacuagcucuagcaggugcauauggggaagcaguguagcacaagcagaguguccaagccuggcacaguaaaggaggagggaacaagagaguccagggggacagugugcugcugacugagccgcagaggcgcucgccaccucagcuggguuucuguaacccagcuggugaaguuaaaguucauaaaauuaaaaacauaagauggcuucauucuuuuggaguucucuuggcuuccuuuuccuuacuccuuuauuuaaucccauuaauugucuacuuuucacccuauggucaauuuggaguuuaauucagcauuuucuucucaaaauaggcugcuuuuggauuaagugauucuucaguugggugguuuagaacauugccuaauaggauuagauagcugcaucuuauauaacuauuaaauuuaaauaaaaucaaacauuugauuccuuaucuggacuagccauacugcagauauuuacaauagcaagguagagcuggcuaguggccaagguacugaucauugcggauacagaauaucauugcagaaaauucuauuauuuguuauuuagaauaugccacaguucuucggacuugugcauaguccuguuguguaugucuauuccaacaucccuguuguguguauguguguguguuuuccuauauaagccuucuguguuuucauugagagugcauugucauuugggaagauuguucguucaucaggcuuucuguuuccuguuguguguauacguauacuccccuaguguuguguuaaguggguccuauuuguacacacauacacaucugugaauguguguaaguuugcagcuuuauucuucuggauuuucuauugauuguauggaagggcuggggaaauuuagauuuacaagcuguauuguuguugccuuaguuaggguuuccauugcuaugaaaagacaccauggcuauaguaacucuuuuaaaggcaaacauuucauugaggcuggcuuacaauuuuagagguuuaguccauuauuaucauagcuggaagcauggcagcacgcaggcaugcguggugguagaggagcugagaauucuggcguccucagguagcuaggaagcucuccucugcaauggguagaaccugagcauaagagaagaccuccaaagcccacccgcacagugacacacuuauucuaacaaggccacaccuccuaacguaccauuuccuaugggccaaguauacuuaagccacaguuucacuugugugaaaauggcacaguugacauuuucaccuucuaaaauuaucuuuuuuugaguuuucaauuuuuuuccuccauagucuucuuuguuuguuuuuuguuuguuuguuuguuuuuuugaugcaugguuucucuguguagcccuggcugucuugaaacucauuguauagaccagacuggccucgaacucacagacaucugccugccuuugcuuccugauuuaaaggcaugugcuacuacuguucagcuuccuccucuuuauggucaguuauguaauucuauaguuucugugcacugccuuccuuacaucugaaccucauccccucuguguuuguuacuucucugcugucaagcuaauccugucuuacugacuacaacugucuggcaugucacuuguuccucccaccuuuacuugcaccaccucucaaguggagagagucguagguguggucucacagaggagccuccuugguucucucucaguaucaccagggucuaagaauagugcauugauuucugaugcuuacguacagaauuaugcuuuugaguugagaugcauuuuuacgcagugaaguugaacucauccacagguuaguguaaaugugagccuccaaagaauuuguuuuuuugugagaugaauuucuagguuguguugcuacugccuugguugugugguugguuaucuuuacugcggucaguuuuaacucuguuccugauuuuauaguuuauugaauuugaacaauuugcucuuauuuccuauugauuagugcuuugcagccuagauuuucuuugucuguauuucauucagugcauacacugaaggacuguguguauuucuugcggaauucucuuacuuuguagcuagagggacauagcucugguuccuaggucaucauucuucuuggaaaacacuggauagaagauuugacuuuauagauacagguuuauggcuuacagaagggaaacugaaaauuaaaacuaacaggccacuuaggauuugcucuaaauucuagguugcauuguacauuagaguuugagauauaaauauucguagguaugguugauaaagauuuccuaaaaaguugugauuuucacugaaaauacauguuuagucuuacuauuuuucccuuuuagcuuccaauaaagacaggacagcagaacacacauaccaaagucagcaccgagcacaacaaggagugucugaucaacauuuccaaauacaaguuuucucuggucaucagugggcucaccaccauccuaaagaauguuaacaauauggugaguaucugacuuacaugaucucugcuuuguggugaauuugcuucauuuucguugugauuuuggaaguuuggagagcauguuuuaaaguauggaaaacauauucuuaggcuuucagacacaaguuauuuaauggacaagcucaagaguaacuuugaaauuuugacuucagguuuuuauucccguugaagcuucucuuauuaauuacucuguuauucgggaauuagaauuuuauaucucuuuuguauuguauguaaaguuaucauaauauagauuccuucccuccuuccuuccuaagcuaugccuucagcuggguaguacaggcuuuguuaauaugcuuucuguuagcugcuuccuuagauguauuuauugauugucccuguccaaacuacguggugaaaaagaguaugaccuuucacuucuaaagugagauuacuuuuucccgcuguauuaaagaguuuucucugccuuccccaaaucugaagcaggcuggguaguguuagcgacucaguguuagagagcagcguucucuguaucuuagcagucagcugacuucaucaagggaguccacugcugagagcugccaguccuucuuccauccuucccacccggccgccucuguacuccaacagcuuuuaacaaucuacuucauacuucuccagacaguagauggacgucuccuucucucaguuugugcuguuugugcugagcugugaagcagccacuuuuguagauucugaggauuaguuuucuagucaggucagcuuuggagaauuuccuuuuaagaaggcuguucaauaccagaguuacagaacugaugaauugcggguaugggcaguucaauagauucuuuucuuugcuaaauuuaugcuuuuuuuuucuucuaaaaagcauaggacguuuaauaaacuguacagugauuuacaggaugcacuuccuguugugcuguagcucuucgccugcuguggagcgcaguauuaguguuucuucugucugagcaugcugcugccgucccaggcgcacugcuguaguuuauauuugcaaucuucuuuagaacucuagggauguuggcauucauguagaccucacugaaaaguuacagggccuguaagguggcucagugcauaaagguaauugucacugguccucggagcaaacugguugaaggugagaaccaaccccugaaaguugucauucucugacuuccacauggacacuguggagugcccacagccauacuagcacauacacuacauguacaauaaugauaaaauagaaaacagaaaaauuuaaaagaaaaaauauauaaugaaagucaguuuuuuuuuuuuuuuuuuuaaagauuuauuuauugguuauauguaaguacacuguagcugucuucagacacuccagaagagggagucagaucccguuacagaugguugugagccaccaugugguugcugggauuugaacuccggaccuucagaagagcagucgggugcucuuacccacugagccaucucaccagccccgaaagucaguuucuuguuaguagguaggugauacaggguucaguuugaaaguaaugaaugcuuaagauucacuguaagcgauguaguagcauucuguuuaauaagaauuaagaaguuaauuguuuugcaaaggaggcgauagcuaaaugcuaauucaggacagguacaagccucuuaacucaugaguuauuuuaaacucuccuugauucauuauuuacccccacacccuucuuccuuuucuuuuuccuucccugucacucccccaccccgauagaguguauaacauacucugggcuggcgccucaaacuuacuucccuagugcuagcauugaacuucuaauccucuugccacuauuuccauaguguugggacuaccaaugucuuuucauuaugucuggccagcuuauagauauuaaaaaauauaaagcaucauguuuuacuguuauauagcuaacagcaggcuuuuauaaauaccucuguuucuuugguuuuuuugagacaggguuucccuguguagcccugguuauccuggaacuuacuuuguagaccaggcuggccucgaacucagaaauccaccugccucugccucccgagugcugggauuaaaggcgugcaccaccacuccuggcuaauaucucuauuucuguuagcuuggaaauuuauuuuuaggguaaaggaagaaaugauagauuuaaguaucauugaauguaaaagacaaaguggaagaguaauacuuuuucuugaucuucagucuuuuauauuucaugugugcuaauuuguagugaaguguuaaucauauuuucugaauauauuuuuuagaggauauuuggagaagcugcugaaaaaaauuuguaucucucucaguugaucauauuggauacacuggaaaaaugucuugcugggguaaguaaauucauucuaaagaggcagguuuugugaauucagucuugagaaugagguggaacacugaaaggucagugugggacacugaggacacacuaagagucuuugugguagaugaauaugaauucuguuaauacagaugaccugauagcucagucuagagaaaauuauucucucagcuuuuauaaaucccauagauauuuaaguuuacuuaaaauguuaaguuugagccccauuucugucucuuaagauuuuguuuuaagaaaauauuuuuaugaaggaaucacuauuccauuuaauuauuuuucagauaucuuuagacccgugccuuuguauaguuggaagaauguggucagcacaccaaggguagucuuacuuuccugccuucaugauaugguuucaacuuuauacagaccccgacaaugggaucuauccuuucuuuguuugaagcuguccuucugaggauagcuacuaccagaagauuuguguaaaugugagcauuuucauaggcauguggaggagucauugaguaccacgcaguucuuucccagguugccucugagucgcugugucuacuuauuucaauuaagacuuucacuuuuucaagauguuuucugcugcauacauuauuuauauucuucccuaaucuuaauuuuccccaaacauggguagguguuuauauaaauacaugaugaauauuuguuuuaaaauugucuacuccauuuaugcuaguuagcuuauuucuuuuuauucagcacagaauacagaauuuugcuuuuauucagaauagcuuuucucuuaugaguucucuacaguaaaucuagagggaagacacuuaaaacaauuuuugaaaagguauuuuguguggaugaguguuuuggcugcguguguaugaguguguguguaugacuggugccugcagagccagaaggggcaucagaucucccgggucuggaguuacuagugguugugaaguaccacgugggugcuaagaccauauucaaguccucuagaugcuuuuaaccacugagccacucucuggccacaagaaggaagagauuuuaauguauuaggauugaugauguaguugagaagagaaagaauguuuagaagugacgaggauuaugcagggaauuggaaaacaaaaacccaaaacaucucacucacacaaaacuuucucuagggaaguuugugagccagaaacaaaaaaaaguauaugauuuauuuauaguuuuuaaaguuuaacuuaaaaugauuuaaauuuguguguguaugcuuacaugugggucugugcuugaguuuaggugcccucaaagggcagaugcuuccgaucccccuggagcuggaauuacaggugauggcaaaucauaauccuacgugggugcugggaacugaacucagguucaaguucaugcaaggagagugcgugcucauaaccacugagcagaaucuccagcuccuguaauauuuauuuuuauuuaugugcauaugggguacauauauggaggucagaggacaacucuuggauagucaguucucuucuuccacuuugacaaggauuuuagggauugacuuuaggucguugguuuuacacaguaaguacucacuaauggaaccauuuuugccagcccagcauaauacuucaaacucuuaaaauuaaaaaaguauuuaucuauuuuauuuuauguguacgaguguuuuaccuucauuuaugaauguuuauauguaugugcgugcaugccugguacaugaggaggucaaaagagggcaucagaucccuugaaacugcaguuacagaugguugugagcuacugugugggugcugacaacugaacauggguccucugcaagaacaagugcuucaaaccacugagccacuucucuagucccugauauuuugaauucucauugaucucuggccauaguccagaauuacagcauuuguaaguuuuauacuuaaaaugguaggaauaccauuuauacuaaaaugguauuuuagcuugguguucucuguuaaucugugaaauggagaacaaaaacacuauuaucuaguggggcggaauugggaguuuagacauugaaaccuuggcagugcucuuaguacuuuguaauuuuugcuguaucagaccaaccaugauugaguugggaagaaugguguagugccucuuuaaguuucacaacuuuuucuucauuaacaauuuuaauugagagguaauguuaucuuggagagugguugcugauauucuuuggagauauccuaauuacaaugaugccauauuuccacaguauaccuguauaguuuacauauuacuuugacuuggucugcuuugaaauuguuucuuuuugguuucuuuuuuucuuuuuucuuccuuuuuuucuuucucuuccuuuuuugcuuguggaauuagagauuguauucagggccuugugcguauaccacugagccacagcccuagaacuaugucagguuagugaguuagcugcugcuuaggaaauaauccaauaaucuguaagacaguugggccaguuuuaaaaguaaauuucauggaauguaaaaaugagauauguggaguaugggggugggguggaaauugcuccagaauaaagacacugaaggacagaauagucaugcugugaccucugaaucacuuuugggucuucagugaauaaaaagcuaugaagacauuuucagugucaugcaguguggauuggguauuugauacauggaaugguguuauuucuuagaauguuaauuguguugaaauugcguuagagaauauccucauuaggauaagcugacauacacaagggcugagauauuauaauguuuauaauguacuuggaugugauuuagcucagcauuauuugaggugcauaguacauguuuuggucagauuauacagaggccaugugcucccuaccuaauuccucuggaaguuaaaugauauaguguacucacagugaauaugaauaaaguuuauugagaacucacagggaacugcaaguuucuaaaaaggaagggaucgggcuagugagauggcucagugguuaaaagcgccaacuguucuuccagagguccugaguucaagucccagcaaccacaugguggcucacaaccaucuguauugggauccaaggcccucuucuggagugucugaagacagcuacaguguacuuacauauaauaaauaaauauuuuuuaaaaaaaggaucaacugauaaacuaggaaaccugugaggcaagauggagggucgggcuucaaugguaaagauagggugaugaugucuucuuuacugaccagguauaggacgauguggcaaauucaaggaaacgauagcagguguugaauucgagugauagcuguguggcuguuccuucuauuccagcuucucugugugcuugacacuuaacugugaauguuugcagguaaaggaaaagccuuauaauuaugugauuauuuccauuuuagcaaccaaaggacacaaugagauuagaugagacaaugcuggucaaacaauuacuaccagaaaucugccauuuucuucacaccugccgugaaggaaaccaacaugcagccgaacuucggaauucugccucugggguuuuauuuucucucagcugcaacaacuucaaugcagucuuuagucgcauuucuacaagguuagugccuaaagcaugugggaaauuaaguaaaaucaauuuuagaauucuugucugcauaagagugguuaacagaaugacaucuggguuuuugaaggaauucuauauauugauuuuucuugacauuuuaauuauauaauauuagaaauuacuuuggagauagugauauuuagacaugaauacuauuaugaauaauguuacagacuuggagaagauaucuccauggccaucucucucucucuuucucucucucucuggugcccgcccucccucccucccucccucccucccuuccuuccuuccuuccuuccuuguggugcuaagguuugaauucagggucuuguguauguaggcaagugcuccaccacagagcuacacuccagccauggguaggcacuguaaacauauucuucagauuaaacuaugcaaauagguagaauaguugagaagaauagcagacauucuaaugaccuaauucucauggcuccuaaauuuccuuaaaaauaaucuaaguaauauagaaacaaaaggaaguaauuacaaaguuggaaagugagguguguuuuagugacuaugaaagucccauuuacugaggauucacaguuuaugccaugucucacagugauaaugaaagguuguuacaggcaaauaaauugauaccccucaaaaauaaauguauugugcugguauaguggcucacaacuuuaaaaucugagcauuugggagcagagacaggaguucaagaccaaucuuuaaugaguuugaauccagccagggcugcacagugagacuccgucucaaccccccccccaaaacuccaacaaacaaacaaacaaacaaggaauugugucaaauaauggaauuugacacauuuccaaauuucuaaguuggauaggccucaagaacuacguuaguuucauuauauuaguuuucaguauuucuauuuuaacuaucuuguggaauuuuaaaauacuguacauuuaauuuagugauuucaaaaaugaaauagucaggagagaucgcuuaguaguuaagagcacaugguucucuugcagaggaccugaguuugguucccagugucugcauggugccucacaaccuaaaccguccaguuuagggaauucaguacccuguuuggacacuaggcacacauguggugcacauacaugcacaguacauucauauaagcaaccauaugcauaaaauaaaaacaaacuuuuaaaaauguaauuucggugaaacggaaaguaaagaaaauguuggcuggggaaucacuuggucuguaaagacccucacagagcaagccugcuggauguggguuuuaucccugggaccaagaaucacuaccacagugucguccucugaccuacaccuccuaacacauaaagcuuaaaaaugaaagaaaauuauuguuuaaauauuuccugaucagucaaaaucauaaccaugauauuacagaugagaaaauuaguuuaaaauggugcucagugggaugaaaugauaaauaaauugugacugauuugucuucaugaaaaugauuugccugucuuguauaaguacacucauauggguucuuaauuaugauaaaauaaaaaguauaaaacaacccacguaaagauuuagugacuaaaagacaaauacaaacagagaaaaguaauccuuuuuacucuuugguuccucucucugucacuuacuagaguuacacgaauggguuucuauuauguucacucuuguuucccagugaggugaaugggaauauacauuaaaauucaagaauuuauggcccgcuauuuaagaacucacuugcaauaaaaaaaaaagaacucuuuuuaauaaaaaguuguucuauaauuaugaugguaggugacaauauucuaugauauuguauccuacagucuuaauaaacuaugaaaagaaaaucaaaacuuuauuuaaugauauaucauugguuaagguuuauauaacagaacauuuccaugauauuuuuuuucuugguuuuucgagacagaguuucucuguguagcccuggcugcccugcaacuugcucugcagacaaagcuggccuuguagauuuauuuuauauucugagucaccauacacugauggagccaacaagguggcaaacagggaaauaggauucugggcgguuauacaaaguaaaacacuuucauuuaggucaguacgagauuaguuuuauuacuuggaaaaaaauucuuaaaaagaagauaaaaagcaauauagaaaaauacaguuucuuaguguauccaugcaggaauuguuaauguuuuuauagaacuauauuuccauaaaguuuuugaguaaguguauuauucuguaaaauagaacaaaugugccaucuuugaaaacccuaaaguugggcuggagagauggcucagcuuuuaaggacacuggcugcucuuccagagguccugaguucaauucccagcaaccacaugguggcucaugaccaucuguaagggcaucugagguccucuucugcuuuguagguguacaugcagacagagcacuccuacagcaaaaaacuuaaauaauuauuuauuaaaaaaaaaaaaaaaagaaaaacccuaacucacccaaagcugcuuccaugaaguuuggcagcauuaguuaauuuauaggcaacuuuuguugauuuuccaagucuaguaguuuguuaucuguugccagaauagaaguuguggcuagaguuucauugacuucgguggcagauuagccagaaaugggaucuaugagauaaaugcuuaauacagcuaugugucuugauuuacuuaguaccagaauuaggaccacucaccuaacagacugcugugaugguuuaauuuacaugggggcaucuuaugauacuauucuuauagcuacuauuccuuuaucuauauauucuguauauauagaagauuugagccagcccucccucccucccucccucccucccucccucccucccucccucccucccucccuucauuguuuugauuguguagacagacuuugucuguguagcucugguuguccugcagccagcucucuguagaccagacugaccuccgucucagagauccuccugcuuccuucuccucagggcuggauuaaaggugugcaccaccaccacccaacuacauuucauuuauaauuacgaucauaaaaaugaguugaacuuuaccaguuucuuugucagcagauguucuuuuuggcggugggcggggcaguauuggugguugaacccagggugucauauguucuacuacugagcuacagcuguagucuucuuuuuacuuugaaaaagggcuucaccaagcuuuucaggcaggccuggaacucaguuuguagaugaggcuagccuugauaguguccucccucagcucucuuagaagcugucauuacaggucuguaacacccacaacagcuuuaguuguuguuuguuuguuucauuuauuaauugaaaaaauuauaacauagcuuuauucugcugaacugucuuaugcuguaggcuuauuacacucuuuagaguuuaauuuuauauuguuuuauauauguuacuugugugucagugccuguggaggccagaagaugguaagggauccauccccugaagcugagauuacaggugguuauaagcuaccauguggugcuaggaaucgaacuugaguccucuggaagaacagccagugcuuuuaagcaaucucuccagcccucauuguacuuucuuuucuuuucuuuuuuaaaaaagauuuguuuauuauuauaucuaaguacacuguagcugucuucagacacuccagaagagggagggcaugagaucucauuauggaugguucugagccaccaugugguugcuggaauuugaacucaggaccuuuggacaagaaguccguuagcugagccaucucucugcacccccccuccucccauuguacuuucuuacauagaaaauuguuuuuuuauaacagacuugauaauacuuaauuuggugauuuauuuauuuuuguuaaauucuuuuagagacagguuucuuaagucauccaaucaguuguuagauauagauauuaucuggacuauccaacauuucccauaaaaauuuuaccuacuugauaaucucuggaucgauuauuaauuggaagugggaaaaguaaaaacauuccccacgcacgccccacgcccccucuuuugacuagugaggcagggucgcacuguguagcuucagcuggccuggaacuugcuguguagcuuggcuggccuugcuguggcuugcuuggagcucauggaucucuccuuucugucucugacuccagaaugcugggauuaaaagugugugccgccacaucuggcuggagucuaucauucuuuauuuuuaaauuggacauacuguauuucuuuauggguuuugugauugugagaauuaaaauccagagccccuugcauuaaauugugcuuucucuuuauuuucuuccuucuuuccucuuuccccucucuuccucccuccuuucucaagaccaggcuuuacuuuguagcccacacuaacaguaauucuccuguguucuccugucuccaguuucccgagugcuuggaugaugggcuaugauaggcaugagccacuaugccuagcugaaacuagauucaaauguaaacuauuucauuuuuuuccuguaaacuguuuuuuuuuguauauuuauaucauuuuaauauaauauaaucuaaacagggaaugcaggguagaggccuguuccaccauuauuccuuuuuagauugaagugauucuaaaaguuggaaaagcucaccugugaguuucuucucucaguaacuacugcuccuccugcccccauguggauugcaguuguagaaaaaagaaaaguuggggcaggggcaguaggauggcucagcagguacuggugcuugcugccagccugguaaccugaguuucagucccugagacuuguaugguggauagagaggacaguucuguuuuucugauugauaaugcaugcucacauauaauaaauaaaugugauuuuuuacaaaggaagaaaaucugauacuccaauugucccaguuuaacaguuauagugucugauuguacagcuguaugauuuuggacuugacuauaauaguugcuaauuuccuugucuucaauuucagggaaaccuaaauacauuugaaaauaugcuccaaucuuagaauuaacuaguuuuuccagaagagccauggcuaaugugagaaauacaauucagaccucaguguuaaagauacaaauacaaaguuuacuggaauaucacuuuuugucaugacucuuaaaucgguugaauuauuuaguuuuuuuuaaauaaauauguucuuauuuuaugugucuuucauucauaaacccccuuucuauuaaaucagaaucuuggacuguucuaagacuuaaauugauaaauuacuuuugauuuuuacuuuucagguuacaggaguugacugucuguucagaagauaauguugauguucacgauauagaauuguuacaguauaucaauguggauugugcaaaauuaaaacgacuucugaaggguagguuuaaauagauaugguuauaguaaacuuguuugaacuggauaucaaaauagauuuuauagugugcauguucuugugaaauggccagaaauguaugugcuugacuggauuuugggcauuugaaaauaauacagcagaacaugaauuuuauuuuuugagacagggucucucuguuuaucccugguuuuccuggaacucauuuuuguagaucaggcuagccuugaacucagggauccaccugccucugcccccugaguucugggaucaagaagggucuuuacugucauguucaucugagaauauggauauuuaaaaucuuggcaguaggaaguuuucuuuuuucuuuuuccuuccucccuucccuuccuucccuucccuucccuuucccucucucccucccucccucccucucuuuccuuuuuuuuuuuaaagauuuuuuaaaaaguuauuuuauguauaugagugcucuaacugcauagagaccugcauuccagaaaaggacauggaaucacauuacagaagguugugagccauuaugugcuuggugggaauugaacucaggaccucuggaagagcagcuagugcucuuaaccaucucuuaaccgagccaucucuccagccugggaaguuuucuugagcuacaaguuuugcuuuuaauaaggagaauguuauccuuuuagaauuugaucccuuaagugacucuaggucgcagaaucaauuuguuugguuguccaggugcuugaagaacauggccuugagcugcuggaguaguguaugccuguaaucccagcacaugggcagaugaggaaggagaguucaagaccaguuugagcuauguagugaguucagugucaugaugggcuauagaggaagcccuggucuccagaaaaguaacaaacgaacaacucccuccacaucaaaggacggagugaaaaucucaaacaguggcuuaauuucugaccugagagacugagcuugaguuauguaagcuaugagaaguuuuaauaguuguguaauacaguuuucaaaauacuuaauauuacaaaacaugcuauuaagcuggauguaguuauauacaccuuuaauuccagcacuugggagcaggagcaggcagaucuugugaguuugagaccagccuggucuacagagcuccagaacagccagguuucuguagagagacccaaucucaaagaaacaaaaacaaaagcaauacagugacagaaaacuuuuuucuuuuuugccuuuaauuuaguacacaaauuuuacauguguucauggaaucuugaauucuuugaaagucaguuuuaagagaaaaaaguuuauagacaugagugucuacuauuuaaaaagucagaaauaucccagauaaccuaaugauaaccucaaggucuuagaaaagcaagaacaauccagauucagcagcaggggacagcuggaaguaacgauggucagagcagaaaucagugaacugaaggaugaaagaacuguguagagggaaacagagagucggcuccuggaaaguucagcaggauuggcaaguccuggcuugucaagacuccaucaaauuagagaugaacaagcugaguuaacuacagguccuagugaagugcagagaaggaggguauauucuaaauaguugguaaaccuagaaaaaaaauggguaaauucuuaggucuaucaaaacugagucaguaugguauuaacagccucaauagaugcauagcaaucaaagacauugaagcagcuauaaggcaauucaaguaguaauaaaagaucucccaacaaagaaugcaagagcagauggaauccacugccgaagucaaacaaaaauuuccuuuacagaaaaauagcaaaggaaggaguacuaccauucugugaagccagcaguacagugauaaauacgcaacaaaaagaaaacuugaauucucaacagaacuccagaagcaaaacuccagaacacugugguuuccuuccagggaugcaguguugguuuaacacaacauagaauaaaccauagaguaaaccagcauguagguuuacgagcagaaauuacccgguaaucacaggugaucagaaaaggcccuugcuucagaaguucagcauuccuuuauaauaaaagcucagcgggcauaaaugaaugcaccaaaacauaaaaaaggaugcauaugaauaaaacccauagccaacauuauacuaauugaggggaaaauaggagaaguuccuccaaaaucuagaaugagauuaagguucagacuuuguguggugcagacuuuuaaugccaguacucagaaggcagaagcagguggaucucuuugguuuaagccuaguuugaucuaguuccaggccagcuaaaaccauauauugaaacacugcaucaaaaacaacagcaaaacaaaaacaaacaaccuaaaaguuuccaguucucuuuuagaacuuaguuuaguaugccaaaucuuaccuagggcaguaagucaagagagagcaacaaaaggaauucagauggggagcaaaaguccaauuuccccagugcugaggcaacaugucuuguuucacagcagaacugaggugggagcucccccugcuggcuaguuuucacagugcagaaguuguaugugggagacuggaggagaaaggcauuaaugaggaucgcaccgcagagaucucugccacccauaauaccaacuuguaggcaagauguacucauugcaguaguggcacaaccauacggaaacaaccagaugcucugugcuugguuuugaagccuguuccccaagagggaguccaugccuggaacugugaaccuaguuaacuuccuaugccugaggucuuugacccuggaagggaacuuacuguuguuguuuaguuaaauugauaaagcgccaagcugccuuuaaaauacuuagguuuauguucgugaguuaaacacuacuuugaaaaguauaaugaauaaggaaaauuuagagucacauggcugcugaagauacugagaguaaguagugggcaagugcucagcccucaaaaaaaaaaaaaaaaaaaacaaaacauucaggcuaccucucugaggcucagggagcaguguagaaugaggagugggaagaguagaagagcuggaagcuaaugagaagagcugcaaaguacugucauguggccgugacacagccaaugaaaaucaugaucucacagcagcagcagcagcagcagcagcaauggaccuauacaagacuggucccaucuacagucuucauauaucugagaaggguccauuugguccuccccuuccuugcugaacuaugaacuacuaauggauuuggguugggggagagcaaacaauguuaucuuuuguguaccaccugaucagccuaucguucucugaugaauaguagcagaccccuggucacacaggugacccuaauuaaacucagugcaucacugaguacaaaaauguaaugugugaauaggauucuagggagucauagagguaauagugaaauaagagggagaaguuugacaggagucagaaauaggcuacauauauguaugaaauugucaaaagaacaaaaauaauaaaguaaugaauagaaauaugaguaaauacaauuuuuguuaagaaagaaaaaaauagacuuuauacacacccaaaaggggauuuauuagaguaaccuauagguguggcccagauaguccagcaauggcugucuccugacagaagggccaagaaccagacuggaugucccagcgguccuaauauuaugcuggaguccuagagaagucuuagaaagcuacugguguucaggauauguuggaauacagaagaaguagcaucaagagaugcccuaaaggaucugcuguacucaagacauggccuucagagcaauccaguuagccgcuggaagucuagaggggccaccccuccuaacacuguuguuguugugaugaugaugaugaugucuguugacucuaaagggcaccaggagcccaaaguuuucaggaagaaguuuaagcuuccaguucaauggaauguauguuaugccuugggcagaaaaguucuccccccuucuggaacacaagcuaguaggccagcagacuuaagguugugguaucagaaaguaaaaguuuuuccuguaggacuguaggggugauagugaguggaaccauuuccauuucuaucccuugaucccuggauuccugaauccuggcuagggagaaacugaaccauauauuagaugcugaagcacauacugcuuucuggagaacccugccccagucuuccaggguucugucaccgauauccauuguaacuaugucuuccaaaggcuauucacaccauucugucaaguuagcugcuucaggagguagggaacaugguaagaccagugaauuccgugagcauuagcccacuauuauauuuauuugccugugaagugaguuacuugguuagaagcaguucuguguggaauaucaugaugauggauaagacauucuguaaguucauggaugauaguuuuggcagaaggaaaagcaaaucuauaaccagaguaaguauucuaguaaggacuaagaguugcccuuucuauggaagaacugguccaguguugucagacugccacuaagucucuggcuggucaccugggagaauggugccauaucuggggcucagaauugggucucugcuccuggcaggucuggcacucagcagcugcuauaaccagaacagccuuggugacuggaaguccauguugucaagcccauguauaacguucuuuuuugccaacauggccacuuuguucaugggcccauuggacaguaacagagauggcuggggaaagaggcugacuguguacagaaugggucauccuuucuacuucauuauugaauaaccccucugcaaaagucaccuuuugaugaacauuuauaugggccacaaguaucuuuacaucauuuguccauuuggagagauuuguccccaucuucccuaguuaaccuuucucacuaacuuuccauucaugcuccuaagucccuaaccauccugccaaucuguuggcuucagcccaugaguucaaaaacagucacaucuggccauuucucauuccaagcagaauuuacaaccaugugaccugcccaaaguuugcuuuacaaugaagauuucucuucacuggcauuuuuuaugguuguucuguaaagagguuauaaugcagcagcuuuccacaccuggguggugccugcauagugugcagaaccaucaggaaaccuuggucuccaaacuuuucuuuucucagucaguugauucuaggaaacaccccaugagaucauagguacaugcuuguuaggaaaagacacuuuaacagaaguagaaaacaagcacuuggacaacuucuucauauaucuugcucaggaccuacuggagccugaucacaauauauucuacuuucauuugauaaugguuugcuguuauguucauccuacuucauggcuugguauuauggcugguaaaaccaaauacuacucagcucaugauagguagcucagauagcauaguaacuugguggcccauucaauagcaggcaaagagcugucucuuaaugggagaaugguugucugcagauggcaauagauccauguucuaaaaucccaagggucuccucucaccuagaggagccuaccaaaggcuauaaacugcuacugccaucuaaagaaccauuuuagcgggucuccuggaucacaugguccaagugguagagcagccugcacagcagccuggaccuguugacgagcuuucuuguucuagcuccccucaaagcuagaagcuuccuuccuuacuugaaauaacaaaacaaagugaggaguaugcuccucuggaauccaaauaggcccaccaagcuuugugcugcuuucuuggucgugggaaagaccagaugcaauaacuuacccuucaccuuagaaggaauauuucugcauaucaccacuggacuuguagaaauuuccuugaaguugaaggcccuugacuuuugucuggauuuauuuaccauccucccauguacauaaguguuaccaauauuuccaaagugguugcuccuuccugcucgcuugguucagucaacaugaugccaugaguauacuggaccagggugauauuuuguagagagagaugcucaagcucccuucauacuaaguuaugacacaggacuggagaguugauaaguacuaaccucgagguaaaacuguaaaaaggcauacuacugacuuccagcugaaagcaaauugcuucugguugugcuuauggacaggaauugauagaaagcauuugcuagauccauagcugaauaccauguaccaggagcugugcuaaucuauccaaguaagggcaucacaucuaguacagcagcugaaauuuagucacugcuugauuaaguuuuaauggucaguggucacucucuaugauccaucugacuccugugcuggagaguuaaagggagaugugagaacuaccaucccugcauguuucaaguccuugaugguagcauggaguauuauauuugguucacuauguucccagaggcaaugccagucucuucaauuugugauuuccaaccauaauagcuuucaguucacaggucaaggaaccaacgugggauuuugccaaugucuaaguauaucuauaccaauuauacauucuggaacuggagaaauaaccacaggaugaguuuggggacccaguagacucucugugauuuggguuucagucaaaauuccauuaaucaccugauaaucauaagccccgauuuaacuggagggccacagugcuauuugggggucucuuggaaccagugucaguuuaaaacgaguguccaguaaacccuggaaaaccugauuguuuccuuuuucccagaguacauuuacccuuguaaaaggucauaggaugggagaagggcuaacaguaaaacuuuuagguauuuuagcaagguccucagggggaccuagccuucucaucauucaaggacuuuggggucugcaaacuagcucaagucuggaaauugauugauaaguugagauaccccuuugcuacucugcaguauucuuuuuguuuguuugagaauuuuuuuuuuugcuuauauagauguaaaaacaaacaaaacaaaauaaaaacauauauuccuggaagcauuauuagccaguacaaaaagauccguaggagucaugccaucauaaaaguuacucugucugugcugcccuucaugauaaauauucucgccuugccuuuggcaaugcagugcugauaccuggcccugcuacucugggggccuaauuaagcccaucccauuuaacuuuuuggauugagcaucagugucuccaaccuuaaggucuggcacaaagagaagagcgggggcaaagcccuucaaauccuggugccccucuuaccauuuugugccucacaggauuagugaagagaaugucuucugggccuucccauuguggaggauucgguuuuauacagcacacccaucauugcaguuucucugaacccuaaaaucccuucaucaauacuaagucaagggacaucagguauccacaguucccuuucaguagaguauggcuagugcuuagccaaccagucacgcuuuugauaccuuuuuaacuguaagaacgucuguauugaacuuagaaccuuaacucagugggcccauaucaauaaauucagcuugauucaguuuuaugguuuuuuuuucaccauuauuucaugcccuuaaaaauccauucucauauauauugcccagacuacggcuugaaugaauucacaaacucaguaaacuuuaguauuguaccacaccuuuguugugaauuucacuuucuguuucgcuccuagaagccuucuuagccuugauacugauuauaguucagaggcaauuauugucgacagacacugagcggcaucaguauugccuugcuugauguuucucuuucagugaaagucacugaaauuuguagacaacaaaggauuaauuuccucaggccaagguacaaaaggaaauauugcaaggugugacaguggggccgcacccuacacuaagagugggcagacuacugccacaggugagacagacgcaucagaauuugaagggucaaaguccucagcaccuguccccuacacuucuccaucucaaguuacaggaucccaccccuuaccagccagugccuuuaggcuccuauuuaccuuagcaacaggagaagugcacuugacuagggggagugcaggcaggcaggcaaaagugaaaaguuucuccuuccauguuccuucacaggugugauuccagauauagucaaguugacaaacaagauuagccaucauauuaccuaaguuucugacaaagcuaucaaaaacaugcauuggagaaaaggugcccucuuuaacaaguggugcugggaaaacuggaucuuucucucuuucuuucuuucuuucuuucuuucuuucuuucuuucuuucuuucuuucugauuuauuuuauuuauaugaguacacuguaacugucuucagacacaccagaagagggcaucaaaucccauuacagaugguugugagccaccaugugguugcugggauuugaacucaggaccucuggaagagcaguuggugcucuuuaaccucugagccaccucuccagcuugaaaacuggauuucuauacauauugugcaacaauaaauucagugucuuaguuagggcuuuauugcugugaacagaaaccaugaccaaugcaagucuuauaaaggacaacauuuaauuguggguggcuuacagguucaggggucagucuauuaucaucaggggagaagcauggcaguaaccaggcaggcaugauacaggcagagcugagaguucugcaucuucaucugaaggcugcuagcagaguauucauuuccaggcagcuaggaugaggguuguaaagcccacgcucacagugacacaccuacuccaacaagaccacuuccugggccaagcauauucaaaccaugacauucaguauaucaaaacucuaaugaaagaagaagacagguaaaaauauuugaagacauaggcauagacaagaauuuucugaaaaggacuauagcacaggaaacaauaccaagacguggcagagagaguuacaugagauuagaaaucgcuaccaagcaaaggacacagucacuagaguaaagagaccauuuacaggcuugggaaaagaaauuuccaggcuuacaucuggcuggggacugguaucuaugauauauaaauaacugcuaaaauuaaacucuaaaaucauuuuagagucuguagauaggcucaugagcugaauagagucccuaauaggagaaauacaaugaccaguagauacuuggaaaaaguuuucaacauucauagacaucagggaaauggaaauuaaaaccucuuucagauucugucucacuucaguugggacguugucaagaaaacaaaagacaacagaggggaaaauguggguggggcuagugggauccugaguagcuacuuuuuauuuuucuguuuuuuucuguuuuuuuuuuuuuucuuuuuuuuguuuuucgagacaggguuucucucuguagcccuggcuguccuggaacucacucuguagaccaggcuggccucaaacucagaaaucugccugccucugccucccaaguguugggauaaaaggugugcgccaccacugccuggcagugaaacuccacuaugacaguuugaaggguuccucagaaaaacugauaacagaccaugugacccagauauacuacuauauuguauagccacagaaauucuuguacauccauuuuuacugccacacaauucacgguggcuuaggaaauaaaccagccugaauguccaucaugagaagaauggaagccggacagugguggcacacccugucucaaaaaaccaaaaaaagaaaaaagaaaaaagagaauaauggauacagaauauuugguacagugaguggugguggcugcaacaguaggcauuugugugguggaguggaggaaaacuggaaaggcuaguggaauggccaaggcuaaguuaauuucuugcucauagagagcuggcuauguaguuuccugugggccaaaucaacgaacacuugaagaugcacaucaugggccauggguaugugggugccacugcugcuuuguacagggcaccuuacugccaagacauuggaguuggcacguaaugcuuucaaaggucucacaaggaagccuaucaguugguaucacuugcagcucacagucuguggugaggaagauggauucaccaauuaaggcuaccacuguugggcauagugugauucuuuacagccacagaugucagauugcaaaauaaaguucagcagaaagcugcccaggaggguuauuuuaaccaaccuacuucccaguguucuguaacuggagcagaagauaacggugagcagauguggaaguuuguuuguuuguuuauuuauugcuuaugaauauacuuuagcugucuucagacacaccagaagagggcagcagaucccauuacagaugguugugagccaccauguaguugcuggaaauugaauucaggaagucuggaagaacagucagugcucuuaaccacuaagcuaucucuccagucuggaauuuuaaaaaauaguuaaauggaaaaguauagacaauuacuauagccaugauaaaacaaaacaaaacaaaacaaaacaaaacaaaacauuuguauguucuuggagcagaguuugguaaagugccuuuuuaugugguagcaguucuguguugauuggccagacuucuacuucguguuuuuuauuaaaaaauauuuuuauaaaauaaaaaacuaaaaugcuauauuaugauaauggaauuuuauacagcugaaaagaaaaaugccaucaugacaauuuccagaaaauggauucaaccggaauuuauuauguuaaguuaaauaagcuugguucagacaaacaagucaugcuuuguuuucuguagggaacuugaauuuaaagguguguuuaugugcauaugcgcacucguguacacacacacacacacacacacacacacuacagauagaucaugaaacggaaaagaucuuaaguaaaggggaaacagaggguauggaauaugugcaauauggaagcagaagguuggacugccugguuaggaagaaagggagccagcuaggaggaggcagguaaaaccggguagguuagggauaacaauggagagcaacauagaaugacacauguuuaugaaaugucacgauacccaauucuuugcaugguaacuuaaaaauuaaaagaauucaaagauaaaguguaaucuaaguauucagauuaucaaaauuaaagcuguccuacuagacagugauggcaagcauguggcagaucgucaguauacagcucaguggacaacuuuucugaaaagcagcucuguagauuucaaaauccucagaaaguauuuguuccuugcugacacaguugcuuacguugaagaaaaagaugguggauaaaacuuuacuuaaguauaaguauuuaucaguacuacucaaaauacugaaaugcuagagauuuguuaaauguaugacugaaaaacauuuaaauaaccagugucuguuuuuuuuuuaagguuuuguuaugugugcauaugcauguagugcccucagacagcagaagaggguguuggauccucugaagcugagguuauagaugguugugaacaggugcugggaacugaacucagguccugugaacagcagccagugcucuugaccacugaaccaccucuccagcccauauagguuuuuguuuuuguuguuguuugugggacaaggccucucuauguagcucuggcuguccuguaacuuucucugcagaccaggucuuuccuugaacucacagggauccugcuucuacaucuacaagguguugccaucaugacugacuucugugucauuauuuaauagacuuaaaaauaagauguauauuguuaucguaugugugagggugcuuuggcugcgugugucuguguggcgugugagugccugguguccgaagaggacagaagagggcgccugaugcugagcucccuucugggugauggguaucaaaccuaggcccugugguagagugucuaguguucuuaaccaccaagccauuucucaguccccauguuuauaguuuuuguuuguuuuguuaaucaauuuaaaaauagagcaaagggaaaacuugauguucaagacauguuugcuuuucauuuacuucugucucuaucaauguagcucauggguuuggggguuuauauuuauuuuuauuauuaaauugcuuauuaauaauacuggaagcaaaacaguuuauaaaauuauuuuauaguaguucugaauuuuauuuguuaaauaauugagaguuaauaaagcauuuuuuucccuccagaaacagcauuuaaauuuaaagcccugaagaagguugcacaguuggcaguuauaaauagccuagaaaagguaagcuucaaccucuuggguaugcaaguuuugauuuugauuaugaccuuggcuguauucgguaucuugaguauaagaaagucaagacuugugugguacuuccucuuaaugggaagaaugcaacacgauauuugugugaagaaacuuaaauucuguguuauuuaauauauuggaaaauugacugcuuuccuauaaaaacauguauuuuuguuacuuguaggcuuuuuggaacuggguagaaaauuauccggaugaauuuacaaagcuauaccaaauuccacagacagauauggcugguaagcuggcuaaagagugacuggguguggggugaggggcggcauggcaccuugugaaacucucagagggaaaugugcugcuuuucaguuuauuuuuuucaaaaguguuuuuucuguuuucuuuguucagcucuaacaggaauuacaguuuucucuccuguuucuguauuauuuccaguccuuucccuucugagcaagugguaaaagaaguuugaagugaagcucuagucuuucauguugugauugaauacugguggcuuucucacagcgugcaugugugugcuugugaguguguguuuccuagaauucuauauuuagguauaucuaaggaggaaauacuauuuuuacuucugaauagcaauuuugggggaacgccugcauaguagaggcuagagacccccgggaaacuaucagccuuuuguuucucugugagacccugagacugugacaacacacagcgauucuaaaauaccaaugcuucuaggaugugucacauuagcucuucuuacacuucucuuagacugugauaguugaguguuuuaauaauucuagguuuuaauuuaaugcaaggauuuucuugccuaauauaaucauuuaauguuuguauuuuucacagaaugugcagagaagcuguuugacuugguggaugguuuugcagaaagcaccaaacguaaagcagcaguguggccccuacaaaucauucuccuuaucuuguguccagaaauaauccaggacaucuccaaggaugugguggacgagagcaacauaaacaaggucaggagggaaacgaguggcugccaucuccugaugggagcagcuuguuuauucaagguguacauuuuaguuauguccaugcuaggucaaacaguugguugcccuuagcagagauuacucauguuauagucaugacugaaaggcucugaccucucuugguuuuaaugcugaauaauaguaaaccagauaaauucuguuauuuaagcuuguauucaccauuaaaauacauuuagacauauauaauuuaccuuuauguuuaugaauuaaauuuggcuggcuauuugcaaauaaauuguauagcuaacaaugcauuuucuaaggcuucagcacaaugacuugaggaaauguauauugacuauguuuuuucauuaugaaacauaacuguccuaacaauuuaauuucugcaaaacuaagaauaaaaauuggaaauuuucaucuuuuucuaugggcugaaauaaccuaguuagauaaaaaucaguuaaaaucaucaggucuuggugauucuaaauuuuccuuauuaucauuaguuuaaaaaagcagagauuuucaagaugguuauuaauugguuaagaguacucucugcucuuccagaggaccugaguucacuuuauucuuauuuauugauguacaauuuuuauauaaucauguuacagcccuaccuggcuuucagagucuuuaaugucaccacauuuaguuuugguuuugguaauuucagucugcaugcaugcauaacacuugguugguuggucuguagguuggcuggcugcucuguguguaugugugcgugcgugauggguagcagguuccagacucauggcacacauaaagcaagcagacacacaagcaugcacagaaacuaaaaugaaucuuuuaacaagaucgacuuuuuugcuuuuuuauuacuuauuuuucaguaaaaaaaugugugugugcucuguguguauguuuguguuccaacagaggcauaagauccuuuagagcuggaguuacaagcaguucugagcacucagugugcgugcuauaaacugaauucuuguucucugaaagaguagcaaguggucuuaacuacccaaaaccauugcuucuggguaguuaauuuuuaauaguuuuauuucuugcuggugcugcuuuuuaaaauuaaaacauacaaggacaaaggccuggcacacuuagagauucuuugcacaucuaguugguccggucugucuuccuccuuugauuggucaggucugauuuccuagugaucuucauaaggucucuauaaccauuugacccaguccugaacuguucaggacauaucacaaaagcagugcacaggugacuggacaacgucacugggcgucaucaucauccucaguaucauuuuaauucugcauggacugccuuuuuauuagcugucaagucuguuagauacuggugcugcuuccaucuucgucuaggucuauguagggcccugagcuccuaaggaacaucuuguuucagcuggcuuuaauuauggcuuguggcaaagcugcauuuaaauuuuuuuuuuuuuauuucuagaaaugaaauuuagauaacagaauacccuuggguauauuguuuagaagacuggagguuucuauacucuagaguaguagaaaaaaagucuaccacaaccaauacaggcuaaugauuaagcuucaaagguaacaucgaaaggaaagauauagucaacuaauacuuaguucaaauguauaguaaggaauguuuccuuucucuauaguaagucaacagagaaaguagagaaaaguguuucaugcauuuuuaaaaaagugcuuacucuuuaaauaugaaaugauagccaaauacaagccauuuguguuuauaguuggaguuuuagaguuggcuaauuugcuacuuuguuagauuuaucuguaguaguacaaacuagguguuuugucuuccuguauuuccauucuguagaagcuguuucuggacaguuuacggaaagcacucgcuggccauggaggaagcaggcagcugacugagagugcugccauugcuugugucaaguuguguaaagcaaguacuuacaucaacugggaagauaauucugucauuuuccuacugguucaguccaugguaguugaucuuaagguaauaugcuguucuuucccuucuauagacuuuaagaaaauuaaguggauaaccuucuuguauaaauauucugcugaagauaauugcuaacucuaaauuuugaguuaacuuagauguuguguucagaggaccugcuuuuguuguuacugugcucauuagacugagaacaggaagacugauaugcacuggguuuccuuaauguauagauagaugcuuggaucguagaugauaucgauagacuauaguaaccaguauuuagugcuuuuuccggcgacuaaaguuuauuauaaucaaugugacuaauguugauuauguuuauauuccuuguuaaguaaauacuucaugacuauuuaaaggccauuguuuucuauugggauuuuuauagaaccugcuuuuuaauccaaguaaaccauucucuagaggcagucagccugcagauguggaccucaugauugacugucuugucucuugcuuucggauaagcccucacaacaaccaacacuuuaaggucagaucguuguuuuauauaaccaugcauauuauauauauguauuauauaacauaauauugaugugguuaucucuauaaaaugcagaaacuauaaagaugaauagguguacuuucauuaguguuucuuuuuuuuaaaagauuuauuuuuauuucaugcaucuggauguuuuagcugcauuuauaucugugcaccauguauguguaugggggugacggaggccagaagauggcauuguguccccuggaacuguaguucuagacaauugugaacugcugugugugagugcugggaacugaaccuagaucguuuuaaagagcagucauuggucuuaaacucugagauaucuuucuagccucuuacuaauauuucuuaacucuaauucuugauguuaauuucaacaccuuaaauuuauuuuauugaaaguaacuuacuuuuugcuguuuuuuucucucuguuuguuaauguacuuuuuuuuuuuuuuuuuuuuuuuuuuuuuuuggcagaucugccuggcucagaauucaccuucuacauuucacuauguguugguaaacucacugcaccgcaucaucaccaauguaagucuaaagcuaguacuguacuacuaacaaguaaaguaaaagcuaguacuguacuacuaacaaguaaaggucucuuuguugauuuggguuauauguucuuuucuuuuuaaggaagauucugguuuuaucaacuguucugaacuuagaccuuucuguaaagcagagcuucccuaagaugaucccacgagcaguugauguccagcugcagcuguauauucagucucuaccugaggcuuuuagugagagggauggaguuaauagaaucuuuuguaaggaauaagccuacaaagugucauuuaaaguucaaaaucuguugagaacaaugccacugaaaaacaauuuagugcuuucuuucuuacuaucuuuguuaaguuggaaggaagaguaauuguaguacagccuagcuaugggcauuuaaaauggugaagcuucauuugauuuuaccuuuucauccccuuaauuagaauaaaacacaugcuuuaaaauaaauaccacaagagacaaaagcauuucagagaaaauagcugacuucauuagagguauuugugcuguguguguacuaaauggaaagcagacaggaagguaguaguagauguggacugcagaauuuaaaaucuccauguauggacauucuuagucauguauguuuuucuuaguacuacuuuuacacauuggcagauaugauacacuuaugaguaacuuguucacuuuguuucuuuuuuuccucccuuaaagucuuugaugacuaauacuuuggaguauuugucuuacuucuaaauucuguuaugacuugugaauuaaaauaauacccauuccuuuauuugccuuggaauuaucaaauuaaaccuaacauuacucuuuuuuaaagguauuuuugcaggggaaaauaacugcugaucaagcuacuuagugacauacucauuuugcuugguggagugcuaguagcauuuuaggauguugggucucuguuuuagccuggccuugcaggacauccaucauucaugaaacggcaaccacgcucuaucuccugcauuaugaacaacuaaaugcuuaggaauaauacagcccucauuugaauaucacugauagagguauaaguuacacuuaauccaguuaguuccaaugaggauaguauugugaaucuaaguguagauagaauauguuuauaucaaaaccuguacauuugccaguguaaugacucaggccaucgucucauugacucagcacauugacucauucuaagcuuuaguuuuaaauuuaaaaaacaacaaaaaagaugauuuuccuaucccauaaguuuauauguaauuccaaaauacuaguugccuaccuugauucaaaauauugaaaguauuccacuuaauuagauaacuuuauaugaaugguuaacauuuaauaaauccaaguuuauagucuuuggauauucugugauuaguuacuuuaauugugaaauauuuuugucuauaauugaauacauagagcacuuucaagcauggacuuggcacugcuguaaguggcugagcugcuucuuucuggguuucaagcaugccuggaguguuaguuccugcaugccuccguccgucugugugccuggugaaagcguguucuccccuuucugaggagugcugcauguaugaaggcagagugugucugcauccggggacauuuguauauaaagcacccauacugacuagucuuuaaauacaucaacaucuguugaguggaauagcuuguaaacaacucagauaaugccaaugugacuuuuuguuuguuuguuucuugagacaaggucucaccauguaguuuuagacggucugaaacuauguagaccaggcaggccuuaaacucagagagcuccaucugccuccugaguggugggguuaaaggacugagcuacuguacccagcuuccaaagugacuuucaguuauacuuuaguuauaccucauccuuagagauugcugaguaaauuguguuuuauuagaguccacacuaccaagacuugaggccaaaaaauacugacuuuaaaguacuuuuaauuguuaaagacuguaacaguaaauaugcagauuuauacaguugaguuuuauagaguuuuacuggaaacuuuuaguaggaaaauguuuguuuucaaguaauaugaauucuuuccuagauucauggagucuagaucuuuaauuuguugguauauauuuucuuuuuaaaugcuuugguucaguauaccuccucagcgcaccuuuuccaugucuacuaagccaguuuacagcuuuaaaaaauuauuauguucuccuaaaagauaaaaguuguaaucuuuuuguggguuuauauagaaugagaaauuauguuuggaguuuuauauugcuucugugagauguccucauacacaauuuauaaguacuauguuuaaaucuaaaacauuccaauuucuuuuagagauucuuaaagucuauucacuauuugaauuuugaugcagugguaauuuuuuuuuuaguaguuucuaaagugguauuuauacugucacuuuuugaaaaugaugugcacuaagagagaaacuauaguuuuaagaucuauauuacaucuguaucaucuuuauaggcuuuuuaaagguuaaauuagaugugcagcuaggaaauuuuaaaaauauacauguaagucaacaugcuacagauaggacaguaguucauugcagauuuuuuucuuguagcaguuuauuguaguuugccuuuuaauaguucauauauugaagguaaucucuggcaagagaugguuaaagaaguauuucuaggguacuugaaaauuauuuaaauaaccuugaggaauguacauaauucacuuauauuagucuuaauauuuuuaauaaacuauuguuaaggggaaaugucuauuucauugacuaguuucagaaugcacacacuuaguaacugacuaaaacacuaaaguuuuauuaacucagggaugucuaaucuuuagugccuauuuuauuugagaauauagccuuuacuuugaaauaaaugaauuaauuccuuaugaaaauagaaaauuauaaaaaauuuuaaaucuuaagucuaaaaguuaauauauaguugucuuaguuaggguuucuauuccugcacaaacaucaugaccaagaagcaaguuggggaggaaaggguuuauucagcuuacacuuccauacugcuguucaucacuaaaggaagucaggacuggaacucaagcaggucaggaagcaggagcugaugcagagaccauggagggauguuacuuauuggcuugcuuccccuggcuugcucagccugcucucuuauagaaccuaagacugccagcccagagauggucccaccuacaaggggaccuucccccuugaucacuaauugagaaaaugccuuacaguuggaucucauggagacacuuacuuccccaacugaaccuccuuucucugugauaaccucagccugugucaaguugacacauaaaacuagccaguacaauagugcauacauauuacugugguacaguuuugcaguuaucaaaaaugauuacauaguaaggugguugugguggcuuaugcuuguaguucuagcauuuaagaggcugaggcaggagaaucacagguucuagaccaguuuggacaacauagugaauuccagcaagaacaugugucaaaaaccaaacagauguaaacuaaaccaaaacugaaaauagcaaccccccacucccaguaguuugauaagauauuaaaggagaugcuugucuauuuaguuuauugauuucugccaagauuuuaugcaguguauaggaagaagucaggacucaguguacucuuuuuuuuuaaaucauugagcauuuuguuacuuucaggugauuaacaaaacauagaaaucugguuacacugaucacugauggccuugggcagaucagugccucaaaucugagagauguguuauauuuugugaugguuaguguugucaauaaagucugaagaugagccuuugagcauauccaugaagauugauaucaugauuacguuaauugagauaggaaggccccugaccacugugugguaccauucccugggcagugagcagagaaagcucuuuguuccugcuuauggauuugaugugaccagcucucuccagcucuugccacuuuaacuuccuugccacuagaaccuggaauugugagcuaaauaaauucuuucucccugaaguugcuuuugucagaguaucuaauuacaacaacaugaaaagaaacggagacaguaaacaccaccaguguguaggaauuggcuaaaucaaauaacugagagacagcauaaccacaauaguuuaacauuuauauuucuuaaauuaaugaauuuuuaaugugcaugguuguuuagccuacuauaugucaguaggggcuagaagaggguguuggauccucuggagcaggagcugcagauagaugcgaacugccauguaggugcuaggaauugaaucaggguccucuguaagaguagccagugccccuaacugcugagcuacuucucuagccucuaucuuacuuauuuuuuaagaugaagucuuucugugaagcccaggauaucauugaaguuccucaugccuuaaccucccuugugucaggauuaaagguguacacuacugugcuugccuuaguuuuucuguaaagagaguuuguaacucaaaauacugugagcugugagaaacuuaaauguuaagacuagcuugauuuuuuuuuuaaaugaagaauaaacuauaaguaggaugaagcuguuaagucacauguauuuacuauaugacuguguuauuuaauaucagauuuuuaauuaaaguauuacaaauugaaaauuuauauuuagagcauauuguuuucauguauagccuauauaaguagugaaaguuuauccagucacuuuucuauaaacugauaaacuuuaaugcuuuuucacaauuauuauuuuucaagcauuuaaaauugaaauauauuaauuaaauuuaaagcaaaagucauuuaaggauacacuuaaacagauuuuauaaaucagcuagauuggcuaaauggaaauaggaaaauaucuauauagaauaauuauuuuauaaacccuuagcuaggucuggggauguagcucagugguagagcacuugcuuaacauacacacaucccaggguccugacuuuaaugucuagcuuuguaaaaacaaagauacuuagcuaggaucagcugucuuuguuuugggugaccauuuagucuuccauguguugugccaucugcuuaucaauguaaaagauuauugauauacuaauggcuuuauuccauuuacuaauuucauguuaauuguuguuuguaagcacuugacuaaugguuuuacauagucuuucaacauuguguugaaccacuaaucucauggaaaacugugaugauagcauucuuaccuggugaaaaauauauaauguaugcauguguuucugaaauuuguuaauacuaaacuuuuuuaaaagauaaaaauugguugaagaauuuuacaaauaguuuuuaaauuuaauauggcauuguugagaaaggacaaccucauuugcacacucaguauucuauuuuaacaugugugucugguuaguguuugacuuaaagauaucauuugaagacuuugaaaaucauauuguauguuugcauggucuuagaaaguuuuucagaaaaguauaaaaguguuuaaaaaaaaaagaagguauacagcaguaaaagaauguguacagcccgugugauuuuuguacucugaucucucguuuuuucuucagucugcguuggauugguggccuaagauugaugcuguauauugucacucaguugaacuucgcaauauguuuggugaaacacuucauaaagcagugcaaggcuguggagcgcacccagcaauacgaauggcaccaguaagaaacuaugagcuuugaauuccaccuguguacugcauuuccagucuucucauuccugcugauggaguuaacggguugacuggguccuuccuucucuaggaaugcuguauugccaugccauugcugcccaguuaacaguaguuauuuuucacuaaacuuuauuuuccuaaaguuuucuagaaaaugcuaacaucuuaaugaaugucaucuuucuuguguuuuugguuuaacuuuuucuuacucaguuguuuuaauuuguuucuuacuuucagaccuuggguuagagugaguguccugaugcugaaugguauacggaaaauuagaaaccgaguaaaacagcuauuauuuaaaggauuuauguuuuaguaaauaugaucauuuagcaaaaauugauaggaacuugacauugauguuuauugaaacuuaacaaaggcuuacuuugaaauuguguuccaagagcuuaguuaauaaagacuauaaauccauagagaguggguuuucauagcuaaugauaagauugugcccaugguuuccuuacucauguguaggaagagcauuuacauggcgacucuugauguugacugguggugcuuugucuucugcuuacuuuccgaucuuauuggcuguuguugcucacguggucaggugcuagccagucacugugucacagugggcuucuguggcuggaaguacauaugauccauuguaacuaccucagaaaaguccuugauuucuuugacuuuuuugaauauaguuaccauuauagucacaucaugucauuucaaaugaaaauguaucaugucuucaccuguugguuuuaucuaauaaacuaugcaucuuacacgaaugguuaagcagguggcucuccagcaugcuuaucuuuccaagaugcuaaggacacagcacuuuccuuuauacaguuaggcucaguccugcccagcugucagaagcaguuucuaaggauuuaaaaaauaugccagguguucaaaugaggaaguuuucuauacaagguaccauuguauuuuuauccuaaaauauuuauuuuugugcuaaaaauaauagcugaaagggcaugucauugauuuuuuuuuuccuucagugcugaagaucaauaccagguuucccauaaacgccuaacauauacuauacuacacccccugccucaaugguauuuuauuaaauaaaauuuaauauucaagcuuacuuagcuuacuuuuugugaugguauguauacaauaccuuuaauguaaaaaaauuguuacaguauauauguuagugguaacauauagaguagcuauguaaauauuucuuaacuagacauuuucuuuaaauuguaguaauuccuugaaucuacccccaccuuguguuuugcacuaggagggcaugcuaacugucaaacccaggagggcuuuccucuguccagcuguaccacucacugaucugugucuccagccucagcuugcugugugcugggccauagcucaguguaaagugcuuucuuaccucuuauacugauaggaagauaauuggaauugguggaaaaccauauuugcuuccuguuuuauauucaacccaacaccucugccacuuaauuuuuaugcacgagugcugaaaugaaaugaaccucauuuauucuuuugaacggccacagauuugguugguagccugacagaugauaaucuauacuuuuaauuucuuagauuugguuguuaguuaacacuuggaggacuuacauuaugcuauggucacuguuuucuuaaagcuguagcuaguaaggauuucuuguggcucaaugacaugauaaacauuuguuuuauuuauauuuuuauuuauuauuuuugguaguaucaguauacauuuaguuuucagagucacuuuuaagcuuuuuuuuuuuuucuuugagauacaggcuauguagcuuuggcugaccuugaacucacugucuuccugcuucuaccucaguggucuaaaagauucauuuuuuuuuuauuauuuuuaauuauaugaguauaugugucggugugugcacaugaaaggccagaggcauuagauguccccuggagcuggagucacaggugauugugagccaucugauaggaguuccuucugguaaagcagaguacacucuuaaccacugagccacuucucuagaccuuuaaagucuguauauuuguauguauaguauugugaauguauguguaauggcuguaggaaaacuuucuuucuguuaguguuuccauuagagaaaauggcaaauuaauguaacccaguuguauaaaaacaggaaguuuuagaguuugggaaaucuuuaagguaaacacuauucuuuguuaaugugugaauagaccacagauaugccugguguuaaugcuaggaucauggguugugccuuguuuacauugccugaaaucauuuugguagcucuuaggaauugagcuaugccuuugcuuugcuguagacauagcaaugcagaaguucuagcugagcauaaugggcaugccuuuaaucuaaggucuuggguggcauaaacaggcaagucaggacuauacaagauugguugauugauuauuuaauauguauuuauauuuuuugagacaagguuucucuuuguagcccugguugccuggaacuuacucuguaaacgaggcuggccuugaacuuaagagaucugccugccugugccuccagagugcuaggauuaaaggcgugcaccaccauuaccugccucauaguaaaaucauguuucaaaaauguucugucuaugaaaagguaaacuauuauguguuucaauauaguauugauuuucuaauaaauaaaucucaagugugggguugcuucccgccucagugguuuauguuccugagugaaagacacccacacagccucuauauuuuaauacacuuuaaacagcacaauagcugagcgacugccuaaucucugugauguuagauuguaccucccgccgauaauuccaaguuacuacucacuaauuucugaguuccaucuuggccacauuaguucaguuagucaacccucugggccacauuuucuuggcccagagccugggguguucuccuugcuucucuauuccaugguggccucugugucucuccucucuccauacucuccugaagcauggcggaugccuuucuuccucuuccuuguggucccaagucugggaaaccuaaaacccuaucuuuuucuucucccucacuauugacugcucauaucuuuauuucccaaucagaauuagcuggggccagguucccugaugcuacauguagacccucuucuguagacuguuuuggaggacccaaugaguauuugaauacaggcagcuauauuucaaagcuugacaacugcugauauuuuggggauaaguuacuugguagaaaguaguaguuauuugaggacuggagagguagauggcucaacaguuaggaguacuuguugcucuuagagaagaucugaguuugauucccagcucccacaagguggcucaggaaaauccuuauauuuaguucuaggggaagaugauacccauauaagcaaacaaaccgcacacaugcaaaaacaaauuuaaagcuuaaaaaacuaacuacuuggauuuuuuuuuucaauaagaugaaaauauguuguaguugaagccaucccaguuccuuucugacucuucuacagaguacccuugaagauguuuugaaugaaguuaaaacccaguuuccuaagaguuguuauuauauauagcuuguguuggauuggauuuuauuguuuuaacucuuugaaaguuuguuugauuuguuuugauaacuaagcaaacuaagaccaaaugugguuacaggaauuagaaugucgcauggcccagcagaguuaggucugaaguuguuuugacgccugccuagugucugcucagcuccucaguugcccuccuucacuagcagguuagcuggguggaugaugacacuuucacugcuucaacacagacucauaagcucccagagcagcgccaggcaccgugggcaugcugguaugcugugugccaggcaccgugggcaugcugguaugcugugugcauuugugagugauuuuuguggaugaauuuauuugauugaacuaaaaauuugucuauuuggguuauuuaucuuucacaaaaccaguuuaauaaauuuuuuccauuaauauggcccuuuaaagaacugccuucauaauguuugucugguaccauuucuagguuuuggucuaaagcugcuuuugaucauuggaacuagcugcuuucauaugaugauuauacccauguuuuuuucuuucuuuuucuuuuucuuuuuuggcacuuuaguaguaauuuuaacuuuuugaaauuuuugucugagaguaauaauuuauauuuuaaaacuagaaauaugcuuuaauuaaaaugugaaguuuuaaauuuuggucuuagaugauaucuuggcauagauguugcuuaccaugccguaaagucagcccuaaaguuucaaguuggcagaugguuuugguuccuaauaaauaacuuaggaauuucuugucugacauagcugacugucuuuaaucagagcauaugugucaguuuagauccuacuaauuuuuguaguacagaagauaaauuaguaaaugaagucuuuuuuuuucuacuuaauaaacaguuuguuaagcagcugauuguuccugacuuuauauaacccacuaauggccauuagauugaaagagguaauuggacuuucucaaguuuagauuuccuacuagucaauuauacuauagagcaaaauuuacauguuaguaccugacauuaaaccaaaaauuacuuaaaaaacaauuacugaaucagauguauuauguauugcugguuguccucugacuguguacuuccugugcagugccaugucacucuccgucacaucauagugaguuuguucaguaaaaggcuucaccuugauuuccuauuagaccuugaaacauacacaugcaugcacaugcaagcacacacacauaucuauagagcaaacauuccacagaacuuauuaaauacaucugacaaacauuuccuuuaguguuggagaguuuggauauuucauuucuuaaaugcuuaaaacuugagcacuguguguguugggugauauagauauagucaucuucaguuguuaaaagaaaauagccugucuacagagacauuugcuaugguugaauaaaggcuucauagucugccaucccuguaucuuucuauguacucacuguaggcauccaggucaaaaguagauugugugugugugugugugugugucugugugugucuguguguguuaguuaaaggaaauagacuggagagggauagagcgacagugaaucaagaaugcaauuguuagauuuuuuuuuaaaucgacuaacauucggaauuauguugaucuauacuaucucuguaauugaacuacauuuucaccagaguucuguuuuaugaauauucuuaggcaaaaagacaaaugcaugcauucuauuaacuuaaagaggaaaugccgucaaaauaaaagagcaaguuccuaacuaaagccaugacugcagaguugccuacagagacuguuucagcagcucuaaagaacauaccuuuacuucuaucugaaaguggauguuuauuuuccuuugugugauaucgaggauucacaauaguuuuucauuucuuugugugauaucgaggauucacaauaguuuuucauuucuuuuaguccagccaagugaugcaucuuacaguguauaguguauuuguguaugugcaugugauauauccagagauccaucccauaauuagccuccaaacgaugacaccauugcauacacuagcaagauuuugcugaaaggacccugauauagcugucucuugugagacuaggccggggccuagcaaacacauaaguagaugcucacagucagcuauuggauggagcacagggcccccaauggaggagcuagagaaaguauccaaggagcuaaagagaucugcaacccuguaggugcaacaacacuaugaacuaaccaguaccccagagcucuugucucuagcugcauaugcaucaaaagauggccuagucggccaucacuggaaagagaggcccauuggacacgcaaacuuuauaugcuccaguacaggggaaugccagggccaaaaaaugggaauggguggguagggaagugggggggaggguaugggagacuuuugggauagcauucuaaauguaacugaggaaaauacguaauaauaauaaauauuuaaaaaaaaaagaacauaccuuuacuucuaucugaaaguggauguuuauuuuccuuugugugauaucgaggauucacaauaguuuuucauuucuuuuaguccagccaagugaugcaucuuacaguguauaguguauuuguguaugugcaugugauauaaguauuugcuaauuugaauucucuaguauguauauucaugugugauauagauacauuauuuuuccucuuacuauuuucauauuugagaaccaguuuuugaacccaagagucaacuugauauuaugccucuaguguuuuagauuauuauuauuauuauuauauauuacuagauuguuauauaagaaugauauaaaugcuauaaaacauuuuuaaaaaaugcaauauuaaauguaugcuuguuagcuuauguuucuaccaguaucauacauuuggugguaugaaauguuuuuuuucaaagcauuuuaaauaauuucuuuuauaaaguauagcuauuauucugaaucugaugucugauuguuucuaaggugaugccauguuuuugauuuguuauuagagucucaccuuuaaagaaaagguaacaagccuuaaauuuaaagaaaagccuacagaccuagagacaaggagcuacaaaugucuucuuuuguccauggugaaacugauucaugcagacccaaagcuuuugcuuuguguaaguauuuuuaaugaaaugcuuugaaauuauuccacuaaucuauuugaacugaaaggccaaaauacauuuaaauuaugaguaaccucuaaaacauugcuaagaaagccaauuccaggaauucuaauauacuuagaucacauuuucuaaccguucccuccgcauugaacuguccauaguagcaucauuugcccuuguucugcauuauaaucagaccuauuucuggggucaggugggacaaaugacuguaaaaucggugugcucagcaucugaacugcucacucuuuuugcuauugcuaagcgaguuaacuucuauagcuagcucccuguguguuccuuugaucagccuucuauuaucauuggcucugccuguaaccauauuagaagagaaaguuaaaaugagagugguuaguauccaguuauugccauagcucugcuuuuuauucccgcaaaugguauuauauuccugagagcuucacuuuggugcacagaguaauaaagaacugauguaaauaguguaaccaggugagaguaaaggauuaaaagcacaggcucuggggaaggacugcuuuacuuagucucggcaccuuaggcuucucaucugaaaagguaggcaguaauauaguuccuaccucagagagaccauuaagagugaaauagauuguguaaggcuuuuaggaacaauucguaguguauaguaagcaauaaaauuaguuacugcuauuuuuaguaagauacaguuagcguuagcauucuuacuguccaaguaaaacaguuugaauuguucacaggauggucuguuuaacuuuuaucaagucucuauaguccuagacuguuggggucggccugcugcucucaugucuggguucgagccugggaggcagccuggaacugaaaaagaagagggaaacuagguggacaagagagagauauggaaccaagacaguauucugaucaaggcucaaauuuuuaauggcagacacgcuuuauaaaggaggggggaagcccauuccugccaaaucauccuuggagccgagcugcaggugaccacguguaggcggacucccagcagguagcagcagaggcaguggcugaacagcagagugauccagggaggcaggcuccacccuaggugaucuccuuaguggcauagcaaagucaaggucuggcucagcuugcuucaggcuugggggaggcuacacuaggccuaucaagucucuagaccaucagguaaagccuucugcuuuacucagugucaggcucauccuuuggugcuuuaugguuuugcagcuaugcucuucaaauuacuaaaaugaaggcauucaugacuaaguggcugugguuucaagaauucuaugaaccccacguuuugagugugugugcacacacguguuuuuguuugauuuuugagacaaaaucuugcuguguauacuagguuggcauugaauuuauuauguaugacauacugaccucagauuuguuggguaucccaggcuggccuugaacuagauguugcugagugcuggaauuacagaaauguacugucaugccuccacucuagaauuuuaaaaaauauuuacauaugaauaguuuuucugauaaugagagauaauagagccagaguggaugaaguuccuaaaguauggguuaccccaaaagaagaccuauuaucuuuuuguguuuuuugaaaaguccacccaaauuugagaguuuaauagaauaaacaguuaaaucuuuaguuuggaaaaguuuuaaaaauuuuguuaguggacucugaaaauuaacuuuguucuuuugguuucucggguguguggcaugaacuguggugacaucucacugugcuugcuacaggaugcuaggguuacucuguuuacuuggcugcaguuuuauguucaccagugaaccagggucaccagugauuuucauguuaaauagguuauuguuugaagaacaaggguugaauuguuugagggaaaauaguuuuuaaguaaaauuugcugucuuccaagaguuauggaauccuuuuuacuucccuugaugaggaugauugaaccagaaucagguaguuuuguaaagcaggcaaaagcuccacccccggccuacuccugcguuuugugggcuuuguuuuguguuugggggaguugagagggugggugggguuuccuuugauaggcuaauugucacuacccaggacagcugccuagcuucauggacagugcuuucuuugcugccaucuagugguuaagugacuuuccucaguaacccaggaaaguaaaacaauauuguacacauaaauucuaaaccuuaguuacuaggagaaauguaaagauggucuccaucaugggaucuuguugaaguaauuugauugugucuuguguuuguaccaucuuuguccugguuccugucacucuauguguucccagcuacuaccauuucuuacauuccccaaucauuucucugcacuguguuagaauggucucuuuaaagacuuuugucaugccugguccaacuuaaauaucuuuuagcuaacguugcucuuggauaacagguaaguggaucuuugaguucaugaccagccuggucuagagugagaucugggacagugagggcuauguagagaaacucugucuuaaaaaacaaaaccacccccacccccccaacccagaaugugaagauugacggggccggagagauggcucagugcuuaaguacuuucugcuuuuuccaaagugccugccuuugguucccagacacaggcaggcagaucacuacugacuguagcuccagcuccaaggaagccaacacucuucugccuccauggccaccugcacccauguccugucuacacacaugcauauaaauaauaaauaauauauaaauaauaaauacaguuauuaaaagcaaaacugaaguuuguuuuucuccuacagaauccaagaaaacagggcccugaaacucagagcaguacagcagaacuaauuacagggcucguacaacugguuccucagucacacaugccagaggucgcucaggaggcuauggagguaaaggaagugaauucugggcuuuugaaagaaagacuguaacugucucugaucuuuuucugagaacuuaauuuuuuaagcaauuauuugacucuuucuaugugcuuucucuuaaaaauauauuuuaaaaauuuuaaauuguuugugugugcauaugaaaaucagaggaaacucagguuucuggucuuggauagcaaauaccuaaccagcuguagguuauucauuuguuuuuugagacaagauuuuuacgcuauuguccugccuggucucuaaauccuaaaacaauccuccuccuucaacuguaauacuagcuagaauuuuaguuguaugucacaagucauguuguauuugaauuacauuguguaaaaaauuuuuggaaguuuguaguuucuuuauuccuuacuuucuuuuuaugucugcauaauggggguagggugugccugcacucgcaguggcacgucuggagaugaggggagagccuguggcguuucucuucuccguccaccuuuauauggguuccgaggauugaacucaggugcucaggcuucuguaacuguuccuuacugcugagccagguaguggaugguagacguucagugugguuucuguuugaggauuucuacaaauaauacuauuaaaguuacuguaucauuuaauauuuccauuagcaguguauugguguuuugguauuucuccauuguugaugacacucauuauuguuuguuuuuaaauuauaguaaaccuacuguguuaacaaaggugacuuuuuaaaaaauuauauuuguagcuggaugguuguggugcaugccuuuaauccuaguacucaggauacagaggcagguggaucucagaggcaggcuaaucucaaccaagccuacauagaaagacccuaucucaaaacaacagaaaaauuacauugacguauuuauuguaugggaggaugugugcauagcacagcauauaggaagaggucagaggguaacuuguaggaguugguucuuucuucccaccacuggguccuagggauugaccucccguugucaggcuucuacugacagcagugccuuuacuuacugagccagcucaucagcuuagaguuuacuuguuuuuaaaauuaucuuuaaucuuuuucuuuuuuuuaguccaguuguuaucccccuccugguccgcccaccaacaguuccuccucccauacgccccucccccaguuuucaaaaggaugucuccaccuccaacccaccccaagucucuagaggguuagugugucuucucucacugaggcaagaccaggcaguccucugcuguauauguguccagggccucauaucagcuaguguaugcugccugguuggcggcucagugucuaagagaucucagggucuggauuagaugaaacugcuggucuuccuauggggucacccuccuccucagcuucuucuagcuuuucccuaauucaaccccagggguccccaacuucaguccacugauuggguauaaauaucugugucuugcugcuuuuugggccucucggaaggcagccaugcuaggcuucugucuguacaucauagcaucaguaauagugucaggccuuugagccugccuuugagauggaucccgauuugggcuggucacuggaccuccucagaguuuacuuugaaguguuauuuuuguacugacaaccuaaacauacaccuuuaaucuaaaugaaauuuauuuuuuuauaauuaacauauacgacuaguuuaagacuuaagaauauauucagcccagaaaguuuccuuucugcaguuaauacuacccuuauuuuguuaccucccuuaaguuaggaaaagaauuuugacacucuuguauugucacacauguuaguucccuuuuccugguuguugaugaauauugcacuggcuuguucacuaaugggcucaauugguagacaacaugcacuucuauugaaugucagccuuguauuccuuugccguccccaucccuucuuaccccgugucuuucccuuggcuccuuuguaauaauugauuugcuuuguuaauguaauuaguuugcauuuuaaauaaaugaaauaaagguuuuuauuuuuaguucagcauaauugcuguaauuguauuguguuagugguugguuuaucucaagguuccuccuguuuuauucuguuuagugucccauuguaugaauauagcacaacuuguuugcucauuuaucuguugaugaucauuuguguuuugcuuuuggcuauuuagaaguacagcuuuugcuggguauggugguguauaccuucauucccagcauucaggaagcagaggcaauuguaaauuugaggcuagccuggucuacaugucgaguuccaggccagccugcuacaaaguaaggcucugucaucaaaaaugaugaugaugaugaagaaggaaaaaaauugauagccuguagguacacacacacacaaugugaacagauuuuuuuauuuuucuugaguaaauucuaacugaggcaaaaaucuuacuguguggucucagaagagauauagcauagcuauaagaacacuggaagaaagauaguacaagcauagaaaaguguaguguaguacauagaaaguaaaggugucuuauuuauguguaaggauguguaucugugaauguaugugcacguguguguggguacccagggaggccagaagaggauauuggcucccuguaguugagguuacaugcaggugguuguucaccuacugagauggaugcuaggaaccaaaggcaaguuuucuggaagagcagcagcaaaugcucuuagcuguugagccaucucucuagccucagauucacuggagagagagagagagagagagagagagagagagagagagagagagagagagagagagagagagagagagagaaagggagagagagagagagagagagagagagggagggagggagagagagaugaagaucuuuuugcaaagguucagucuaggaaguaaaagugcaugaaguuucuaaagcuucaggauauauaaaacaaaauauguaaagaaagaagcuguuuacagugcagaugcagugguguuccugaguacuuuccuaacauccgguggguaaggauagggugggguuguuaucauucaguagaauacgacacugaauucagacaguacuuuuuuuuucccaagcauaccuggaagauauuuaacauagggguaggcuuaaaacuaucaaaguauugaaauauuauuuuauugccauaguagaauuaagauagaaaucaguaagaaaaaaguuuauaaauuuuaaaauguugauacuguguuuucguuuacauacuacugaguauaauuuaguacaacuaccauuaaaugccauuuuauaauaucagagcuaaacauaaaugcugacaguuuacuccgggucauagagccagcagaagugcacaugucuacuuacaaagcacacaaaauggucagcagugcagcuuguguuguaucuuccuccaaaguaugagccauucagaugugucagccgaguagacaauuccuguuauauugauuuaacugaauucuaugcaguagugaaaauaaaaugaacuggauugguggcacacucauuuaaucccagcucucgggaggcaagagacaggauaguugugaguuccuggacagccuuaucuacauggagaguuccaggucacccggugcugcagaguaagacccugucacuaaaaugaugaagaugaugaagaagaagagaagaaaaauugauggccucuaggucacuaauacauaaaucuaaguugugaacagaguguucauuuuucuugaguagauuccaacuaauguaagacaacaacaguaacagcaacaacagcaauaaccaaaaaccccaaaagaggcugguuuacauagagaguuccaagacagucaaagccacauagaccugucugaaaguaaacaaaaccagcaugaguacugaugagugcagaagcugcaugagucucacugacaugcugcucaguggaaauaaccaaaggccaagugcauucugacagcuccguuacccgagcuucacaggcagagagagcagcuuggugagggcaggcagagagccgaugccugggaagggggggcugaagggccuuucuggugugggcgguguugauaggugguggugggacaugcagccagugaaaaaaucucugagcuuuccucuccaaaugaccuccugcuguacucugugugugugugugugugugugugugugugugugugugugugugugugugugugagaucauccuagaaauugcuacauugcuuauauugucuuuggaggaucuauucaaauauuuugauuauuuucacuucaauaaucaauucuuacauuucuugucuuguguauaauauauaauucaagauuaaaaaaauacauguaucuuccucuaauaaucaggaagaccuuaauuauucauuaguaagcgaauggguuuauauuuaagagagugguauuucaacuuggcaugcuauuaaacauccauucaaaccugugugagucguucagccguguuggagaaugcuuaggagauaaguguaauauguuuggagcuagcugaagcugucagucccacacuguguagaauuuauucaucaucaacaaaccacaauaauaaggugcuucccaacaaauuguaucaucuaaugacuccauagccaucuuuuuaaugucaguguauucuuugauauuggcaugaugacauagucaccuuugagguacuucucagugucuaucugucagauaacauauagcaguauggaaaauuaaagcaaaggagaacaugaaaagguauauaauuucauugaaaugcaaaaaacuaauacauuuuuauucagauuaaacaaaaaacuuuauuaaacagggaaugugucaccuaaaaaacccuaaaauaucccagucuuacuaaaugccaaaccauuugugagugacagaaauaaagcuaggauuugggucuccgcuucuguucuuuguacuauaccagaacacugccuucucuucuuuguaugcauaauaugaaguccuucaaaaacacagaugugccuuggcaguucaacacccuccaaaagagaaccucaguaugccuuagguucuuuucuuuucccaucaaacacuuugcccaaguuucuaugauaggccuagagccccugaagcaguggagcucauaaagacugugccccacugaugcuagcucucucuugucacaagagaaagcaacugcuuuaaauucccaaccaaauugaugccacuguaugaaaaacaauagaaaacccuaaaguaccaggaaauuguaucaaguauuuguacaguaaugguaaacugaauugcaauuuguacuaucuguuuuuuuuuuaagugcuaacuauaaguuacuuauuuguuucagguagcaguucauugauguuuuaauaacaggggcuuacagaucccauauguauuuuuaccauggacugacuguacugagcacaauagaauuugcuagggaauggggaagcauuguggaauugcagucuagcuugagcagguuugaugaaagggucuuugcuuuaauagucuuugauaguuuuaauuuauaaguuagcauauuuauauggaaguuacuuauuuaaaaugaguuacuuaauucuggcuagucgucauuaaauacuuuaaaauaaacuguuauuaaacauaaaguuugcuuuguuuuugccucucugucaauuuuagaaaauaacuuuucugucuaaaauguuuauguaacaagcaaguuaauuucuacuauuucauuguguggguuaauauugcuguguguguuaauuuuaggggagauacuuuguucuagaguuauuaauuauugaaaccucauuguuuauuucuugaagcagcuuuguguguguauauuguucugaguucauucacagcucccuguguacgccauguagaguaaugauggcaggggcagagggaguuaguucgggguugguauucugacuggcucucaaaaacauguuuuucacuguucuuaagacagacccagcugaguuuguuagcauuuguaaaacgagugcuccaguguuguuuuccuaaagcacuuucagugccuucuccuuuguacauuucaggcuuugcugguccuucaucaguuagauagcauugaucucuggaauccugacgcuccuguagagacauucugggaaaucagguauauggauuuucacauuuuaauuuggcuauugucuuuaaauauuagcuguauaauauuuaguucauuguuauauuuauuguuauaaguagauauuuuucaauuuuguuuuuaauuugaauugaaaauguuagaauauuuaacugucagagaacuaacacauauaugcaaaaaaguuuaaaaaugguguuaauuuuuaucagcuggcuacaaguucuucuacuucauguauuauccuuugugguguacuucuaagcaguuacaauuguguuuguuguuuugagacagggucuaacuauguagccuuggcuagccuagaacuuaacuguguagaucagacuggccuuaaaguccaagaaauccacuucccucugccucuggagugcugcgucuaaagguguguccuaucaugccuggcuauaauuguguguguguguuuaaguuuauuuauuauuauauguaaguacgcuguagcuuucuucagacacaccagaagagggcgacaaaucucauuacagaugguugugagccaccaugugguugcuggguuuugaacucaggaccuucagaagaacaaucaguguucuuagccacugagccaucucaccagucccauaauuguuguuuuuaauagauuuuuuucaguuauaagacuaaaaguauugacauuuuguaacuuagcuuuucauuuuuaaacuaagcacguggcucaguaguacaguauaugauaugcauugaaggggggagcuaugaucuuugucaaucuucuguaugcacuagugguuuuagugagucaguuacagacaggcauauauguauaaauaagaaaauauguacaggauuucacuauaccuuucugaagcugaguagaugguuuucuuuaauaagcaugagggcacuacauuaggaagauguaaaucuauaaaccuaggccccugcuauugucucaucauagacaugguguguuagguauguggagaccgaguuaaaaucuaaccucuuauaaugacauaguuauuggagacauauguaauuaacuuuuaauuuaacacaucauaaaugcauuuauuuaacuuuauauauacauauauaaauacgaaauagugaagcauauaaucaauuugaauugucagugagauauuuuauauuuuucuuuucauaaagucuucaaaauuuguagugugucuuacuacaguacauaugaaaacacauuucauuauggacaagcuucauuuaaaguacucaaguggucacacgugggcggcucguagcuaaacagcacaauuguauaguaucauagaguauacagaacgaauuagcaaucuuguucucuaaagggugggaaauggaccaggugucuuggcucacccauucuguugugagucuguacuuucacguuuggagcaagaaagcaguuacagacugggaaugagggacuguggcuguguuccauugaaaccuccuuuauagauguuagaggaggcauggcuuuguccuacaagcaacaguuuuuaggcccuggcuccagacuacucuugcucugcagucuuugcugugcaugugaauuuauaauuuuuuuuuauccccaccgcaagaauagaauuuuuuaaaauguguuguuauuaacauuuggauaaaaccuguaaacaaguaaaacuaagccucuaaacguacaccuacuaugaaauaugucacguuauguaugauuacguauauguauuagguucgugaugauuuuguaacagugaacuuuauguuacugcagcucacaaaugcuuuuuuacaucugcaagaaauuaacuagccaucaaaugcuuaguagcacagaaauucucaagugguuacgggaaauucugaucugcagaaauaaauuucuucuuaaaaauaagguaagcacagugacuuuuucuuuugguuuucgagacaggguuucucuguguagcccuggcuguccuggaacucacucuguagaccaggcuggccucgaacucagaaauccgccugccucugccucccaagugcugggauuaaacgcaugcaccacaucugcccggcugcacagugacauucuuaaauuagaaauaucugaauaguaaggagauguguuuucauuuuacugcuaugauaaacaccaggaccagcaacuuggguuggguguauuugucuuacaugucuugauggcaauccaucauugggggaagccaagacaaggaacuaaagcagaggccauggaggaacacugcuuacugguuugcucucuggcuugcucauuauacaaccuaggaccacugggugacaacugccgacaguggacugagcucgcccacaucgaucauuaauggagaaaaugucccacagacuugucaacaggccagccuuaaggaggcauccuuuuaucuaagguucccuuucuaagauuacucuagcuuguagcaggugacaaaaagcuaaccagcacagaacaaguuaaaaaguuuuuauuagcuagauuauauccuacuucaacuccucacucaaugacauacuuaagagaaauguaaguacagaagguauuaucugguaguccaacauuuaaauauucuagguuuuaaguugguaaauggaagguuaaugaauucuaguugacuuaaguaggauucugggucaggccuaugaagaguagaggcugcugcaaucaaagaugucucaaauaguguuuucucuuuauuuuuaaguccucaugacuuggcucucggagcuaaucuaguccgggaaauaaucuuucaaaaagcuaaagggcagaaguuuuaaauuuagguuaaacuuguaugucucccuuaaagauuuugucuguuagcuggguaugguggcacaugccuauaauuccaguacuguugaggccagccugagcagaguggauuccaggcuagccuggaguacacauugagauguuguuucaaacaaggccugaggauguagcuuaauaguagagcacucaaguucuguagaguuagggaugauuucaucuuuuaaaaaaagaccaggaaucuuuuuuuuuuuuaaauuagaauaaaauuuuuugguccugaacaguugaaacauugaaguucuggggaacaggaacgaaccuaacguuucuuuuaacauguaauuuuuauaaucaauuucaagguuuuucuauuaugacauaauugacauaauuuaaagaauacuugauuuaauuaauuuuaauccaggccuagaauuauagcuauaagaaaccuuaccaagcaucuugauacaauuuuguuuagaggacugcugauggagagguaagguuauuuguaucuggcuuaucuuguguuuaugucacagaacaaaguuuguccugaagauuuuagacuuaagaauuuugugccuuuggcauauugucuagcauggucaguguuaguaaucuaguagugaauccgaggugcuuugugagggcuggagagagcacucagcagugcugaguaccccgacaaggcaaaacuguaaucuguagauucguaaagucuuacaguuuucuugugauagauuuuacaucaucaucuauauuguacuugguuuggagguuggacaacugagagguguuugaaagaaagauagugcacaaaccuuauuuaccacaaugggguagugagugcuucuaacgggaaagcuuuuggagagaagguuuuccagggcugccuuaaaauagaaagucaguucccacuaagcacucugucagugucauugcuucaggaggauacgucuucuuuccagcaggcagauagaagcuccugucauucucucuaccuuuauggaguaggaugugaaaugucugcuacuggaaauaccacucagaugucaguugaucaugaugaguuccugcgugccuguacuccuggagcaucucugcggaaaggaagagggaauuccuccaugguagguaacucccucugugacucuccuguaucaucaucucugcucuuccuuucugaguggauguugguaaauuucgauuaaauaauuuagcacauuaguuacagacugcucagaauuuaguuguagugcugcucacuguggaacccugagcaaauucuucauaacucugugccuuaguuucucagauugcaggagaugauagcagggcaugguggaauacaccuguaaucucaguguugcagaggcugaggcaagaggaucacaaguuagaauuuuuguuuuguuuuuuuaaagacaggauaucacugaauagcucuggcuauccuguaacuuacuguguacaaagguugaccucaaauugagauaucugccuguaccaccaugcccagccuuuuaaguuuuccuuuuuuuuuuuuuuuuuuaaauguguauggguguuuugacuaccuguauaucuaugcacucauguauaccugaugccccacagaggccagaagagggcuucuggucccaugaacuggagucccagaugguugugagcugccuugugagugcugggaagcaaacccaguucucuggacgggcaggccuugcucuuagugcucuuaaccguugguuuaucccucugucccagaggggacaaguuugaagguagguuuacauaguaagacugucuuccacaaaaugaauaaucagaaagcaauuaauaauaguaguuaauaacaaauaauaaaaccaguauaagauuguugcuccagaguuuugaggauucgaguagguagaauguaaacaguacaugauuauuugaccguguggcugaccacucuaaucauucugaugugaacaagccauucagauguaggaguugaauuaaaggaggcucaaauuaauuaaaaauaaaacacaguaguuugcuuaauuuuuggauaaguguugcuaagauguuauuucuuucucucucucggcuuuuauuuuuauuuauuucuguauacauacauguauaucuguauugacauagucgugcuuugcagcacaggcuaccuugaauuugcuguaauccuccugcuucacccuugcagguacuguaauuaaggucagucgugcuuggcaagauuuacauuuuuagacuaggucccaaauaugccaggcuggcuuugauccucuugccaauuccacacgagugccaagauuauagaucuguauugcuauguacagcaggacauuuauuucuguauguaaauguccuuaacauaaaucaaaauaugagcagaauuauaaaaucauauggaagguuuugucuuucagacagagagccuuguuaugcuuaaguuucacuguauguagccuguugaggcagaaaccucaaugagcccuguaggagcugcaaugugugcuucgccuguguccuuggcauuggcuuuccaaguguuucugccucaguguuaguuugugggucauuguuucagucagugcuuccggguguuuguuucuucccuauagaccucuuccuuugucauuaugguugacccacaaguggaucaguuuuacugcauuggacucucugugucuuuuuguuuguuuguuuguuuguuuguuugagacaggguuucucuguguagcccuggcuguccuggaacucacucuguagaccaggcuggccuugaacucagaaauccgccugccucugccucugccuccugagugcugggauuaaaagcgugugccaccacguccagcuucucugugucuuaauuguauauuuguuacagacuaucugcauuucuggaaucuaggauaauaucuauuccaauugaaaugcaguaccauuauaugaaccauauauugguucacaucugauuuagaguaaggcacaucagaaaaagaucuuauuauuagaaagguaaauucuuauuuauuuugugugcuaugguaaaugguacauuguugaguuuguaaauaaagucaccuaaguugcagauacaucccuccuuccucccaggauagcacagcagggugcaguggaaccccaccuauaugccgacaagcccagaccaagcuagaaguggccuuauacauguuucuguggaauccugacacugaagcuguucugguugcuauguccuguuuccgccaccucugugaagaagcagauauucgaugugggguagaugaagugucaguacacaacuucuugcccaacuauaacacauucauggaauuugccucagucagcaauaugaugucaacagguaaauguggcucuuuuuuuuuuuuuuuucucuuacucuuuuuaaccauguuacuuugacugacaucuaauuauuuuuacaguggagucuauuuaaagaacaguuugaaaguuuucaggacaaauucauacgguuuacuugaaauccuuuucugaacaagguagauguaauucagugacauuugaaauuuacugaauuuuuaauauucaaacuuauugguaacuggcacuguaaguugauguuaguuauagauuauagaaauuacucugcuugaauuauaaaugggaagauuuuaaacaccuaggcauauauuuccauaaacauaggugggaagauggcuguuuuauguuguagaccuuuuggaguuggggaucaaugaauacucuugcagagguuggugagagcacgugcucaccucgaucaucagaaucauuuguuucauuccuucacucuacucuguguguggggcaggcucccagaugugaagauggcucuaaacacuaacuggguuugcuugcugucuuugcuuaggaagagcagcgcuucagaaaagagugauggcccugcuaaggcgcauugagcacccuacugcaggaaacauugagguauggccucagcagcugcagcaccucccccucccuauguuacuguuagcuaugugaucagaacaacuugagaagcaaagcugaguuaugugcauauuacaaguaggguauucucagaaccugcauuacauguugacuuugaauucaccccuaaaguugcucccuagugauaauugacuucauuuuaggccugggaagauacacaugcaaagugggaacaggcuacaaaacuaauccuuaacuacccaaaagccaaaauggaagauggccaggugaguuguuuuuuucagugaauuuuuguguauuaauagaucuguugcuucacuuaaguaauccuugaugagcuacgaagaguaggauauuauauggaguuguuuuaagaauaccuguggucugucugucuguuugccuacucuuguagauauuagccacauguaucuguuagaaugucacuuuuaacucauuuaauuaaacaaguuagacuuacuuuuucaauuuuauaguagccaagguucaguauuuauuuacucaguuggauaguagagauguaaaagguuacaugacuacaggaauauuaaauaucucugcuagaaaccacuuaguugagagaccaguuacucauugauguucuuuguccuuuguugaaguauucaaagaacguuuagaaaagaucuaauagcuguagauagagaaagagaauauuucuaagaauucucguaacguguguuugcuuugagacaggaucugguuauuuaccuuugcugccuagaacuuaaaguauagaacaggcuguccuugcccuugcagugauccuccugccuuaacuuuccaaagcugggguuacagaggugugccucccugucuggcucauuaugcuguauucuuagauacucuaauuaaaggggcugcugagcacauaaucgagcgcacuuuaagguugagugcaauuuuaaacuuuggacauuuuauuuaacuauuaucaucaagugaaucauuuuauucagcaacuaccaccaauucucuauuacccuagaaauuaagaauuaacugguuuguguauaacuaauuuguauuacuauacugcuuucauuaucaggucuuugagacaaacuguuuauccuccaauugcuguuuuucuuguuauggucacuuagagcaaguaaaaguuguuuugaggaaauaauacagccuuagucaugaaaguuuuucuuuugagggugggaguguggguguugacuguuuaaaucagcauagaauucauauacuguagaguuaucuuucauaagguggucaaccuaaugauuguuuuuaguauagucacagaauucuauaacugucaguuuauacacaaucaauuuuaguacauuuucaugcucucacagaaugcccccucccaccaaaccugcuccccauuagcuauuucuagcucuaacuugcuguauuuccuaccucucugucucuaccgcuccagccuugaguagcugcuaaucuauguucuauuucuacaaaauuaccuucucugaguauuuuguccaauggaaucauaggugauaugggccuuugugacuagcuuuuuuucuccuuaaauuguuuaagguucaucacuacacaucagagauuuuuaaaaaggaauuugacacuucagggugauuuuauucuagcuaugacaaaaauguauuaaguggcucucuaauguguguaugguagggauuagagagauggcucaguguuuaagagcacugguugcucuucagaggaucugggugugaguucuagcacucacaugauagcuuagaauggguuguaacacuaguuccaggaaaucuaacauccuccuuuauuuagcuuuuaggcaugcacaugguacacauauauacauacaggcaaaacauuuauacacauaaaacuaaaauuaaaaaauaauaauguaugugguaguuucaaguuuuuuuuauuauuauuauaaaauguaccuuuccuacugguagaaauggauaagaguaauuuguaagauuuuuauucagucuauguugaauucaugcuuuucacaaaaauguuguguuuaggcugcagaaagucuucauaagaccauuguuaagagacggaugucccaugucaguggaggaggcuccauagacuugucugacacagacucccugcaggaguggaucaacaugacuggcuuccuuugugcccuugguggggugugccugcaacagagaagcagcucuggccuagcgacauacagcccaccuaugggcgcugucagugaacgcaaagggucuaugauuucuguaaugucuucugaagggaauauugauucaccugucagcagauuuauggaccggcuucuguccuuaaugguguguaaccacgagaaaguggggcuucagauacggaccaauguuaaggaccuggugggucuggaguugaguccugcucuguauccaaugcuguuuaacaaacugaagaauaccaucagcaaguuuuuugacucucaaggacaggugacgucuucuccacuuuguuuuuuaccuuucuuuaugaauauaauaauaguuugaaauaaaucaagacuguuucuuucaaauuauuuaaauuauagaccaacaugauaauucacuuacaacuuuaaaaccuuucauaauuacagaaaaaaaaucauguaaccuagggaucaacuugcuucuaaagaacucaggccuguggguaugccuggaguuaggagucuuggcugugugccucguaccucuguguaucuguguguuuguuuacuugccuguagugugccugcgugugaugguuacaucaguuucauugcccugauaaugguuucuguucauugauguuagaucgcuaaugggcuguuuuuugguuuuguguguguguguguauagguauuacuaagugacagcaauacucaguuuguagagcaaaccauagccauaaugaaaaaccuacuggauaaucauacugaaggcagcucugagcaucugggacaagcgagcauugagacaaugaugcuaaaucuggucagguaagcauucuguccugaaucacagcagagucuuguuuuaagagguaagaccucguaugcccugauaauggggaugaugaaguaguuugccauuguuuuacuacagacccagugugacuauggcaauaagauaaucagaaguuguauauguuccuaccuaaguaaaauuuaaauauuauucacgucuaaaauuacauuuacuuaaguuuacuuaaagauuaaauuuagaauaccuuaucuuuuguccauaucugaucauuuuuuuuaauuccauguuuaauuagauacguucguguucuugggaauaugguccaugcaauacaaauaaaaacaaaauugugucaguuaguugaagucaugauggcaagaagagaugaccucucguuuugucaagagaugaaauuuaggugaguucucagaagagcaaagcagggucuuguaaguauuauguuaaacaaaguguagaaaaguagcagagcuuuuuguguggggaggggagggagguacauauuugugcauauuuguuuuuucugauuauucuuaaccaacuuucucaaagcucugugcccacaagcauuuguuuuucuguuuuguuuucagucuuucuuuuuuuaaaaauucucuccuuuccuggaacuaauuaauuuauggucacuaaaaguuucuguuuccacauugcaaagggacagugcaaagaaccagcaucugaauuguaucuguguccuucugacuuuuauuccaucaccccugauagcgguaucuguuguauaaagucacccuagccccucagcuguuuucacuaguagagcgcuguuuugguucucagcauaugccuacaguuccuucagucagaaagccaaggcaaaaguucagggccaaucugggauauacaacuauaugauaaaacuuuugucuaaauaaucaguaaacuauguguuaaaaacuuacuuguucuuuuccuuuuuucauucugcaggaauaagaugguagaauaucuaacagacuggguuaugggaacaucaaaccaagcagcagaugaugacauaaaaugucuuacgagguaaaauaaaacagaacaaaauggacagagagagagguggggaggggaaggaaaacggagaaggagagagggaaagaggcgguuuuuaaaguucuaucauguuuuacuuuacucaugaaaaccaguacagagauagcugcuagguguguuaaguuguuuuguaggugguaagcuuuugcauuugagauauuuaaaguuccuuuuauuauuuuacuggaaggacuuuuaguugaagcaugugagguagucuuaggaaagugguauuagcuuaggaaguaugguuaacaguuauugagagaagauacauaaagcauuaggcuguauuacuuuagauaaaaacauugauugaggaacauaauuaugagucuuuguaaggcauaauugcguacaugcuguaaugacagaugcuugauauauaucagaaaugguaacugugauuggaugauaauuucauccauuuuuuguucagguaugacuugguaauauguacuauuuacugauugguugauuaauugaguuucuucuaucaucaucaucaucaucaauuuauccauuuggccacuuauuuauucguuuauuuauugaugguuuuucaagacaguuucucuguguagcccuagcugucuuggaacucauucuguaguccaggcuggccuagaacucaaugaccuaccugccucucuaccucuggggugcugggauuaaaggcgugcaccaccauugcuuuuucauuuuuauauugugauauuggagcuugaacccaagacuuguagaugcuaaacuggauuacauucuuaaccccauaauuuugauuuaaugaagauauuaugcuuaagauuacuuauucguaaguuuccccaccaguuuuaggucuuuguguguguguucugagcuuaguauauuuacugauguuauuuagguuguauuuauaguuuacuaagugaaguagagagcgccuuaguuuccugucuaaaaggcucauaguuucuaaaugacuuuuuuuuagagaucuggaccaagcaagcauggaagcaguaguuucucuccucgcuggucuuccacugcagcccgaagaaggagaugggguggagcugauggaggccaaaucacaguuauuccuuaaguaaaugucagccgccaaaaaacagcacaaaacacaaauacagcuuucucccucccacagcaguguaaccaaaguagcuaaauauuauauuuaaaaguagaccuaauugcuucuaauuuuggccauugacugcucucaugaaaauaacaugucuacuugugaaaagacagaaccaagauagaaaaauaauuuguguuguguuuuuuaaagaaaacagugggauaguugaaauuuuccuuguaaugaaucuagauugccuguuaagucauuuaaaaugacaaugucuaacugguuuggaccaugaguuuuguagcuaaauauuaaaacugacuuuugccagcagacaaggugcauuuucugugcuuaugucaggaaugaacacuguacuuugucaggauaaaauaaugcuaccagcaacucaauaaugagccacguugacuucugaccccaguauuauaaaagcagaugcuuacaguggcccacauaaucauucagaauggaugguuagcuugcugguugguguggccuucaugguguaaggucagucucuguauuuuccagguacuucacauuauuuaugaaccuuuugaaugacuguagugaaguugaagaugaaaaugcacaaacggguggcaggaaacguggcaugucucggaggcuggcaucccugaggcacuguacagugcuugcaaugucaaacuuacucaaugcuaauguggacaguggacucaugcacuccauaggugagaucaaaugaaagcuacauaaaaaacuggccuagcauggugcacaacuugaaucccauuaaccaggaggaaggaacaagaagaucucuaugaguucaaggucagccuggucuacacagugaguuccaggacagccaaggcuaccagugacccugucuguaaacagacaaacaagcaagcaagcaaacagaaccaaagcagaaauauaaaaccuagagagcugggugggaaggguggcucagugguuuacagcaccggcuggucuuccaugggaccuagguuuaauuuccaggccucugugguaaccaggcauacaugugauugauacccagacauuaggcaugcaaaacacucauagacauaaaacauaaaaaucuagaguugacauaacaugcaaaaugaaaauugcuucagccaggcuguggugguaaauuugcaucugucuauccucaucaggcuuagguuaucacaaggaucuucagacaagagcuacguuuauggaaguucugacaaaaauccuucaacaaggaacagaauucgauacacuugcggaaacgguguuggcagaucgauuugagagacuuguggaacuggucacaaugaugggagaccagggagaacucccuauagcuauggcucuugccaauguggucccuuguucucaguggguaaguuuauugagaaaguaggguaauagaaugcuugacauacagcuagugcuucaaaauaaguauccucagaaguguuuauuaagugaauugacaaaauuuaagaacuggaaaaaauuacauaauggagagcugagacuguagcucauugguagaaugcuuucccuagcaccacagaaaauccaucaugauugugcuugccuguaaucucagcagcuuggagggugaaagcaggagguucagaaguucaagguccucuuuguuaauagugaguuucaagccaguuagagcacuguaagacugucuaaaaaaauaauuaaccaacuugagucauuaaaccuuuuuucuuaauguguuuugcuucuaacuauugagaagugguugguacuccuaccccugacuaguucuuucuuuccaacccagugacaaacguucauggaaucaccaaugggaagaaauguaaaacagcguugucucuuaucuuuacguauauauaaaguaauaguuaaccuaacuauuaguuguuaauaguacuaaaucuauaaucugcgauuugugcucaauaacuaucucugccuuacacaccuuaauuuuuacuugaaguauuacauuacauuugaaauuugcauuugaaggcaugcuggaugugguggacacacucauaauucuagcacguagcaaguggaggcaagagauagaagacucauaagucaucgacggcuacagagcaaguucaaggccagcuugggcuguauaagucugugucuccaaacaaaauggacugauaaaauaccauagaaauacaugacuauuuguccgucuacauuuauuuuguauucuggggauugcugucagggccuuacuuguuaggcaagugcuuuaucacugaguugcacccucugcccaucaaacuacaacauucuugguaauacauuugaaaacuuugaggaagcuuuuguucauuuucauuuaaaaaagccauguugaucccuauauuuuugcucaugccuuuagucccagcauggggaggcagaggcaggcaggucuaccugauaaguucuaggccagcuauagcuuaccuagugaaucccugucuucccccccccccccacacacacacacuuucuuaaagucguaugguuuauuuuaucaaaagaggaaggaaggaagaaagcaaggaaggaaaagaaaaaagacuuuaguaagaguaaacuucuaauuacuaaaauaauuuuuuuuuuuugccuaaaaacuguaaugagagggugaggaacuggaaacugguucaggagucuuucagaagacugggguuggauucccagcucacauggucacuucacaaccacuuguaacuccuguuuuaggggacugggugcucucucugccucccuaggcaaagcaaccauuuacauaaaauuaacaacagaaaugaaggaacccaccuguagcagaggcuggaagggcgguuuggugcuuaagagugucugcugcucuguaaaagaaguggagccgaggucccagcacucccaacagcaccaaaggagaggugcuacucaugugcacgugcguugaaaauacacaguuaaaaacagagagccugugagaucaugguuuuuguaucuaaaaauaaagcucauauuuuuugcccuauaacccugcacuuuaccugggcccugccuuaacugucuucagcugaugcugaggcucuucuguguacucaucucaaaugugauaacuguuucugcccuagaguacccuugcuccugcuuucuaaaauacuucugugguugcuuugauuugauucaauucgguauuaguaaaauuauuuaacaugagcucuaucgucuuagcaauuuuguugguuugcuuacuugcuuuaugacaagagauggucucaccuugugggcucuggcugaccugaagcucacuguguagacaggauggcuuccgacuagagauccuucugccucuguuuuccaaaugcugggggcacaggcagcaucuccacagcugacucacuuacaauuguacuuuuaugcccauuuauuagaguacuccuaaauuauuuucuucaaaccuaaaauuuuucacacaucuucaaauguauuaucaguaaauauuaugaacuuuuuagcauuuaacuguaauuaaaagucauuuaguaguuuucuuaaugaagagugaaggucugaugaugcaaccuagugguagaguucuggucuagcacgcaugagacccuauucuugaucccuccuaacacaagaaaacaacuguugauguaagucugugaagcucugacuaauauuucuaagcuuuauagcacaugacuuaaaauaccucuuuuucuucuucuucuuuuucuuuuucuuuuucuucuucuuuuuuuuucuuuuuucuuuucuuuuuuuuuuuuuuugagacaggguuucuuuguguaauagugcuggcugucuuggacuugauguguagaccaggcuggccuugaacucaaagagaucucugccugccucugacuccugaguacuaggguuaaaagcaugcgcuaccauuccuggcuugacuuaaaaauaccucuuacguauuuacuuuuuuggagauaggaucucugguguagccuagcuggccuggaauucauugugcagaacuaggauauagccucaaaugcacaaaguuucucugccuccuguuacagggguuaaaggcauccaacaucauaccucgccucaauuacuuaaaauuuuuuuugagauuuuauuucauauaaauagguauuuugccuacauguauguuugugcaccauguguauaaaaugcccaaaggggccagaaguggcuguuagaugcccugaaacuggaauuaaaacaguucuaacugcauguggguacugggaauugaacuuggguccucucaaagagcagccaaugcugcuagucccccaaauuauguuuuuucuuuggcaauuuugaacauauaaacaaucucucuugaucacaugcaccaguguuucucaaccuucuuaaugcugugacucuauaauauaguuccucguguuguggugaccaccaaccauaaaaucacuuucauugcuacuccauaacuguaauuuugcuauuguuaugaguaguaauguaaauaucuaauaugcaugauaucugauauguaaccccuaugaaagggucauccaauucucaaaggggucucaacccaugaguugagaacugcugauauacccguggcuccccacuuucccuccccuucccuucccuucccuucccuucccuucccuucccuucccuucccuucccuucccuucccuccccuccccuccccuccccuccccuccccuccccuccccuucccccuucccccuucccccuucccccuucccuccucucccccuucccccuucccccuucccccuucccuccucucccccuucccccuucccccuucccuccucucccccuucccccuucccccuucccccuucccccccucccucucucuuucuuucuuucuuuuuucuuuaaaaaaagacaagaucucauuauggccuguaacuuuuuuuuuuuuuaacuuuaucugcauuuauuugaugcugaauuuauucccgggccuugaguuuuguuucuucaguuucuuccaggauuucuuuuucuucugugcugccucuucuuugggcuuuggaacaaucuguugcuucucagugaggaucaucucaguguggcagggggagcucauguaugggugaauucggccaagagcucuguagguuuuuucggcaccccuuagguuccuuguucaccuggcuguguucaaugacuagagcauccacgucuaaacccagcauucuuuuuuggccaccauccagccuguuuggcccacuguuuggccugggcugcaccuaccaacaccaccauuauuccgccagaauggcacacauugcuucuuuaaaguggcauccuucagauacuugguggcuuuguggauaugcauacccuugauggccugggcaguuucccgaguguucuuaaagugaacaugaagguuuggaccucuugauuugcgugauuuugugggguuuuuuugggucaagagaguagcaaaccaucuucacaggucucuucuggccgcuuacaggaagaguagcuuggaacuuuuuaaaagaaaaacaaaacaaaacaaacaaaaaacucaagaccaaccuuauuagcagagcuguugaggaaucacggauaucuacuaacaaugugguggguuuuucuccuuguaacucuuacguaacucaaccuggccucaaauuuccacucuucugccuuuacuuccucaguucugugauuacaaguguguacuaucacuuucucuaaugaaauuaguuaaaaauuuaauuugauuauguaaauacauguuuuaaaagccagcuguuuagaauuuuggggguuuaggagaaaggaugagaguagaaaggcauuuacuauggggccuaaaagcaacagcuacugcugucucucuuuacuauugugcuggaauugaaacagcugacuuucugugcuagaaaagcucccccccacccccucccacccccgcuccugagcuggagcccaagcccggcaacuucaguuugucccuaaauucuuauccuuuuuucuuaacucauaauggaggggagaugucaaagauguauuguguaacuacagggggcuucugggguauuuauaguuuggauuauucaauuuuuucccuuacuccagugucuuguucuuagaaucuugggaccaggccaggcugagggcagggcucuggaccaugauggacuuuaguacuguuugaagguugagggcucuuuuuuuauagcuacugguauuuucuuugucuucucucaauguuggguuuaacagugaauuacaguuuuaauaauuguaaaacaaaacaaaaaaccacaaaaacuuuaaggaauuuggaaaggauguuguacaaauaauagaacuguuagccucaauccuaacucuaguuguauguaaaucugacuggauuuuggguuuuaacuaucuagccgacccccuccauucugauuuuuaaauaaucccuuaguauuugcauuuuuguuguuuauuuuggccuuggucauauuguauuuaaucauuucuaagaauacaguuuguucaaaacgaacacuuauuuuaugauguaauuuagccagauccugaugucuuucugccuugccuucugguaaagccuuaaaucucucaucuuucacuaguuaauuuuuagcauuagcagcuauuagaaacagguauuaaaagucaucuuuaauagacaaagguaaauguuaggaauaauaaguuauuguuuaccuugauuauuaugaguuuuagaucugccuuuuuucuauccuuuuacaaaauuuuaaaucuaccuaagagaaguaaaauuguucacagaaacacaauugugcuuuguuaccaggaugagcuggcucggguucuggucacucuguuugauucccggcauuuacucuaccagcugcucuggaacauguuuucuaaggagguagaauuggcagacuccaugcagacucucuuucgaggcaacagcuuggccaguaagauaaugacauucugcuucaagguuggugucauugacuuugugugcacacgugcacuagguuuguugagaagaaacuuagagacuguguggagggauuauguuuuaaauguaggauguguggcuguggcuauuggccugacuguguguuucuuuagguguauggugcuacuuaccuacaaaagcucuuggacccuuuauuacgagucaucaucacaucuucggauuggcaacauguuagcuuugaaguggauccuaccagguuugucaucuugucacaguugcucccucacuccuccccaguacugcaugaggucaccuuuaucucauguuccuguccuugguuuucuggugguuuucaugaagacgauaugucacuguguagcccagccuguccuuaaaccugugcucuuccugacguggcucacucuccuggggcuauagcccuucucuucacuuuuaaaagguuugcaguuuuuacacuaaagguuauaugcaaacaucuuccuuaaagaauaaaaacauuaauagauaucauuaaaggcaucauugauuaccaccuauggauaccguugugguuuacuccggucuguccuuuucccauucuuuuguauaaacauauauguaauuuuagaagauguauacuuuauuguaauugcuuaauuuuaaaagguaauaaaaauaaaucugugguuuacaacccaauucuuuugguuuggucauaggccuuagaucuuucuguggaaguggaugaagauugcuguuacucuuuuauacugcugcacaguauuaaguaguuuagcgcuguuacuguuugugcagugcaguagcauagccuuugacuuugccauaacuuccuuauuauugggguuuugaaacaggaucucacagcauaauuguggcuguccuggagcacgcuauguagacgaggcuggccuggaacucgcagagauccaccugccucuuccccuuaagugcuacagucauaugcuaccacacccagaccaacguccuuauuaguauucuaacauugucuuuuccacacucaagcuguuugcaguggaaaugauuuuucuaaauguaaauggggcuuuuuguuucuuuguuuuguuuuggugauguugauaauuguauuugagcccuucuacaugcuaggaagugccuagccacuaagccuauucccaaccuuagcagaaaucuuucugaugcuuauuuugugagacaucagcagcagucugcucuugucagcaaaaugcagcacagauuguugcuucaucugaaccaccuuuaccucacucaccguguucauuucauagucacucuaagcuccaaggaaaaguacauaguuuuaaauguucuugcacaagguccuaugggauuagagauaccuaauuaauuauguuucuuaugucuguuuuuaagaaauauuauuuuguguaugugcuugauauauguuugcgguauacauguaaaggucagaguauacuuccaagaaucaaacucagaucaacagguuuucuuggcaagucucuuuauacauugagccaucuugccuacucaguccuucauuucugaccaugauaaaaaaucaagaaggcagacuaagcauauggcuaauggcugagugguagauaacuugccuaguagaaugagcccuugguuccuuccauccucagcaaaacacacacacacauacacacacacacacacacacacacacacacacacacacacacacacaguuccuuccauccucagcaaaacacacacacacacacacacacacacacacacacacacacacagaguuccuuccauccuuagcaacacacacacacacacacacacacacacacacgcacgcacgcacgcacgcacgcacgcacgcacgcacacacaaucuaagaagauauaaggaagggagacauccauaaaucagcuguaacuuucauuuuagauaaaaaaugacuuucgagggguuggagaaaugacucacugauuaacagcacuugauguucuucuaggggacuucucucucuucgguucccaacauccauaucagguggcucauagcuaccuaucagugcaguuccaagguaucuccuggccuuagagggcaccugaauguguggcaugcauucacacagauucacacauauaaaugaaacccuuuagcuuggagaaagagaccuuagauccccagguacauaggauuguuuacacuugagccugugacccacucugacaagucaagauuuugaaagucuacucucuauguucacaggaagaaaaaguggcuaagaauucugaggggcugaggacauaguucagugauggaugcuugacacaaaugcagaaggcuuuggguuagcucccuagggaaagcuggaaauagaaaagaaaaggaaaggaggggaggggagaggagaggagaggggaugugggggaagauacagggccagaggaacaagaggaagaagugagagacagauuggcugaaagaaagaaaaacaccuagcacagguaguuuagauuguguuuggcuuuugccauucugggaaucaaacuaugggcucacauaugcuguagaaguuuucugccacugagcuacaucucuagcugucaauaacuugucagagagcugaggucccaaggcaaaccaccauuccaaaacuuguguagaaacagcugaauacagaguggcagagcuuaccacaggaaagagcugcuggagccaguaacuaguaggggugcuuagaccauaauuaguggacuugcuuaaacauuagacuuaauggggcccaaucugaaggggcuaccccaccuuuacuucaaaggcuugcugaguuuccaggaggaaggugagagaaacaaccuuugugcuuuggacaggugaaacagaaucauuucaaauaugcucauuggauucuguuauuccuaaccaacauauguuucaagagaaaaacacucuuuccuagccuuaucugaccuagagaaugggcuuuuagcuaccuuugaccuuccaccacacccacagccuuucugucucacauauggagaaagauauggacaaaagcuguccuucugaaggauuuaaggacuuugaaguucugagacuuuggcccagcauacaacaacggagcuagaaacuuagagcauuaaacagauugucagaaggggaggagaauauucuaaacucacacguuaggauguucaagggagaggagggcauuaacgcggguucccugggcaagcacaagucccagaucccaugugagcagccugcaggguagccugcugguuauugccuccucccuuccgacgcuugauggggccuuguggggcagugagagccaguccucaaguccugaguucuagauggagcaguucuguugcuuuagucuuuuaauccaggugaggcuuccgugagugagugagcgagcuguguuugcaucaguuccacuccagcuuuuccuggcuuccuccaacugccuacuggcaaauguaggaagccauuuagaauuguuuuacucuguguguguguacauguacgugcacacacguguguaaauuuuuauaugcacaugaccuacuucauccaauuacauugcccuuauuugcauauguuuagggcugaaaaguuaggauugaggucucguuuugaaauaaaauagcaauaccaggaaaaaaaaaaucugggucucccccccucaguaccuaucgguugccuguaguucuucuagaaguggaaccuuguuaaaaucuccucccauucacagaggcgugggcacgguauugucuuugcaggucucaagcaggcagccugagaguucaugagagcauuccugguuuguugaaaagacacuguuaagcaguaguugaccagguccucauguuuuuuacagucagucccccuuuuccuugauguuuccugagccuuaggcauaacguuguguuauaccuaaggcauaaccagacagcccaugcucacugacuuagucucugcguuuugaccacuuguaguucucucuaauaaccucaaaaacuguggacugaucccuaccuacuagauuagcuaagguugagcauccagaagucaaaaagauucuaagagcuaaagcuuuuugaacauggugcuggcacucacuaauguugacauuaccggcaugagcucagucugaaggccacacugugguggagagaggccugacgccuacaaguuguccuugagccugccucugccugccugccugccugccugccuuucugucugucugucugucugucuuucugucucucuuugucucucucuccauacaaaugaguaaucuaaaaaaauccacaaaaaauucucaaauauguaaguaauaucuauggcuguuuuuauguuaaauucugguuuccuccagauuguuuuugucaugguugcuguuguauuuuuguaguuuugaauggguccuguacuccaugcuggccucaaacuugcuaccaaacuaagaaugaccucaaggucauucuuuuaguccuccugugggcaccuucugaguuuuggaauuucaauuuuggguuuguuaguuuguucuagagacuuggccauuacuguauaguugaggcuggccucaaacuuauggcugucacugucuccuuaugaauauugagauuagugggagccaugcacuugcuguuauaacugcuccuuuucuuuucuuuucuuuucuuuucuuuuuuguagcaaauuuguuguuuauuucagugaggaucaggucuugugaggggugauuuuuguuucaauagucauguauguuugguuuucccuuuccuuuguuacagguuagaacccucugagagccuugaggagaaccagaggaaccuccuucagaugacagagaaguucuuccaugccaucaucagcucuuccucagaauuccccucacagcuucgaagugucugccauuguuuguaccagguaugaugaaaguuggagauugccacucuaaguccaaagccaacugagaggagugucgugugcagagucagcugcugaccaucauuuggacacguacuauaauuaggauagagagguagcuaaguagguaagagcacggcugcucucacagaggacccagguuugguguccgguacccacauggugguucacaaccaucuuuaacuccagucucaggggagcucgggcugucuucugacaucuucaggcacggggcaugcauguggugcauauacauacaaucaggcaaaacaccuacacacagaggauaaaauaaaccuaaaaaucaaucugaacgagcuaucauuagauuggcgucacauuuucuucagagauauuuaaagaacuuuaaggaaaauaaauuagccuuccuuguguugaaagcaacuaauaauucacuauguguacugaaaugagguauaguaugcauuuuugcuuaucuuuugccuaaauuacuuacaggaacuuucccacuggaggcaaguucauugcuuuuuugcaguauaaaugauuugaacuguaauuuuggcuucuccuauuaagagaucacugguuuaucuccuguuuucucagguuaggcuaauugucauauguauuuuauguagaguacugcuuguaagauagagaccacaccaugcaguagcuaacagacuuuuuaacccagucacagcagauagugcugcuaaauuuagauguccacaaagauucuuucuguguugaaagaacaaggccuguguucuucuguaacuucugauuuugaauugaguaugcaguuuuaggaauaauuuauuuauuccgagggauugccuauaaaucuguauuaauuuuucaaauagggaaaagaaaacccagcauagguccugaauuuuggaauaaggguacaaaaaggaaaggacuuacacauuuaccagaacucaugcauuucucugacuuugcaguauuuuuuuuucuuuuuucuuuucuuuuuuuuuuuuuggcuugcagcuuuaguugcuuagagacauuaacaucaucagugaaacaccauuuaaaaaagcugcaugaggcugcuaugugaguuuuucuccauugcuauuuuaaaagauauaucucagugucuauaaaaagaaaacuuugcauacauaaaaauaugauaaaauauacuuagcauucaguuacuggacguguugugacuuuacugcguuuucagaaagcucugggaagcuuaggaggcuccacauaggucauccaccuagucgggugugcagcuacaggguggguuaacuagacuguggugggucaucccccuagucgggugugcagcuacaggguggguuaacuagacuguggugggucauccaccuagucgggugugcagcuacaggguggguuaacuagacuguggugggucaucccccuugucgggugugcagcuacaggguggguuaacuagacuguggugggucaucccccuaguggggugugcagcuacaggguggguuaacuagacuguggugggucaucccccuaguggggugugcagcuacaggguggguuaacuagacuguggugggucaucccccuagucgggugugcagcuacaggguggguuaacuagacugugaugggucaucccccuaguggggugugcagcuacaggguggguuaacuagacuguggugggucgugcugauuacacuguuugccacuagacuuuaauaaaaacucuucauguggcuguucccauaaugaaaaauguauuuguaucaucagcaaacuugggcaccaguuugagagcacuauacuaguaaaguaaaaagaauuggacacuuaauaaguaugugggaaauauuucauuaaggaauaaauuuuaucauuucuacacauuuaaguaagcaggauucuugccagccuuccuaguuagguuuguaaggaaccaugaacacaaggaagugcugacugguggcucacucugugcuacccugcgcugugcugcuuagugcgcacuugacagcagucugcauugccugcacugcaguuaccacauuaaagcuucauggaaacaccaugcagauguuacuuacguaagcauuacuuuguaguggguaaaguuagugcagacuaccauggagcagagguuuuguuguaagauuuuuuuuuuuuaaugagcaaauauuacagugaccaaagacaaagauagaaauaaaaaagcuucagacccaaugcauuuuucauugagucucuggucucuguccuuaacucagcuuccucccucccuccagaucucccuccagaucuuccucccccccucccuuccuuuguuccucuuugggcuuugcuugcccuuguagcuuuggcagugacauaauggcacccuuguacuuuuaugcucugcugggaaggaugggaacccauuuuuucuuuuucuuaguaaacauagcuccuuugaggauuuacuggggaaacuuuggaagcuaagugaguauauugcuagcugauuuuuacuugaguucagauuugguuuuucaggcuuuuuuguaucuuguaaucagcucuauauauuuuccuucuuagaaaagaugguuaaugcuauguaacaauaauacauaauacaauaauaguuauaauauguaugacagauuuauuuuuugucucuucuaaccuucuuuauuuuuuauuagauauuuucuguaugacagauuuauaauuaaauuuuuuucauauacuauuucuuuucuuucugauaaauuuggaacaaagagaaaauaauuucuagagugaauguucaguucuggugagaaagaugggaaauagcuacugugaucuuaaguaagcauugucuuucccacuucacgugagguuauauauguguguuaaagcucaaugguagcugcauaccauaauugaaaaaaaucuggauauuuacaugguuauauuuuguaaacugccuuaaagccugaagcaaagcacacugagaugagcuuuuaccucugcuuccuaggccuaggauggugcuggcgucuagguauacaagagcugcuagauggauggguggaugguggguggauggugggugauggguggauggauagaugauggguggaugguggggggauggugggugauggguggauggugggugauggguggauggauagaugauggguggaugguggguggaugauggguggauggugggugauggguggauggauggaugaauggguagauggauuuaaaacugaaggguuucaauaucuuagaaaucuagaucaaaaauuuguauuaugguuagugucuuuuuugcccagguuugccuugaacucuugauuuucuuccauucaccucccaaaggcuaggauuacaggcauuuaccaccauaacuggcucuuauccuaaguuuuuaaaauauuaaaaaaaauaguugguauaaucuaaucagaaguuuuaacuuugaagaagucuuuauucuagagauggagcuguggugagacugacaccuguguggguucacauggaugguuugggcuuuugcaugggagagggcagucugguaaaucgccauccauaaugaaugacauuuuaaaucagauuuaaauuugaaucuacaauauuaucuucaauuucuuaacuuugguauuaauaaacuuuuuuuccuaguugaugcuaacauucuuuuuccaaauacagcggcuuucaauaaacuuagcaccauuucagggaucacucugugggcauuggaagaugugagauuauaacagcacuccauuuaaaagauggaguucagagucucuaaacuuuguuuucugcauaucuauccauuuaauuuuuuauuuaauaacauaauuaacugcuagguguuggaaaaauaacucuuaagucaauugaaggauacacagagaaguauuuuauauaucagaaaaaauuauguagacacaauguuuacaguguguggucuacuucauaauaaauauuuuaaguaaaauuuaucaaaagcuaggaauugacucaaguauaaauauuccugagauugcuugaggacagcuuuuccaugacuuauagccagaaauaguagacaugauugggucucaccauuucuugcuguuuauuuuaugcuuggcuuaaaaguguaauaaaaauuaaaauccaggauuaaacuucaucccucaaaauucaguugauuucugccuuucuguugguuccauuuguguuacauuuuaccgugaaguuuguguacaagccaacauuguuuuuguugcuguauguagccggugcugugacuuguuugugcucaucucuguucuguaggcaacuugccacucccuacugaauaaagcuacaguaaaagaaagaaaggaaaacaaaaaaucaguaaguuuggagaacuuuuuauuagcuguuucuuucgaagcaaaccccaaaucuuugcuauuuguuaagaacaucuucacuucagcuauuugaccuucacugugaaaucauucuacuaauucuggcacaaaauagcucucauuucgauuaacccuggaauuaaguuacauugaaacauucucuguguuccuuugguuugauuuaccccaaagguauuuuuuugugcauugauuuauuacauugaauauccuugaucuaauuuuauuguuauuuuuaaaauuauaaaugaaugcgaaagaaacuuaauuucaaggccuuaggggaugcugacugucuucauucuugcuucucguuugcgggucaugugagugguuucuuuuucuagaaacaaaagcauuucuugauaaauacauuguggguagaaaugugaccuucuccugucccaacagacauuaaauucaggacgcacaugcuagagcuaccaaaaccaaggaucauuuccuaacucuaaucucaaaguuacuaaguuuuaauguuuacuccuuauauuuuuaccuugauaguaucagccaccccugauuuagacauuugugcuuagaucauagaaauuuuaaugcugauguuccuuuuaccuuagaggaaaugcacauuacaucucugcagugaggaggaggcucagugaggccaugcucacacaggagcccacugugcaaacgugaccugaguauauugccugcuucugacuuggccgucuugugaaaggaagaaaguuaugauugccauaauuauuuucuuccuacgaauaucauuuguucacaguauaacuugcauucauuuuuaaaauaacaucaucuguggaugugacuuaccauuauccaguuuaguccugucuuuguucacuuaauccaauugauuauagagaaugauguaauuaaagaaaacccccaaaaaacaaaacaaaaaaaacccaaaacaaccuuucacaaguuguagggaguuuuauuaaaaaggaauaauuuaaagucauauuugucugguuucaucuuucauuuucuacuuuuacauauaauaaagcuuuacauuuauaauuguauucaaaauucagaacuaaauuaaacuucagagacucauacuuuuauuauguccauucagaauuuucuuuuugaguguacuaugugaaauugaucaucucugaacaaauggauuggauuggauggcucuccugcuuaaaacauuuuccucuaaugcuucagccuucuaauucucagcauuguggguuuaacauuauacaucaucacuguggaaauuaauuugcuguuucuaacauucuuguuuacuguuacacuaaugucauuguguagcauaacauaauuaaagucaggcuuucuguguuucucuagagcauguauuauagcuuuccuaacauuauuaugguuuuauauaaaaauuccuuggaauuuuuuaguagauauuucauauauguaugaaauuuuggaauguauuucucagcccauguggcaguccuuaggaaacuaagggggucuaauuggcaguacuucagaacagauucuauaguauaaagacaugcuaaucauuauaaauuuagaaugucauguuuugaaaguuguuuaacggaaucuaauucuuucuccuuugagagcaagcugaccuccuuuguaauaagugaaagaaaguuucgaguuugggugauuagcuauguugacagcugauucaguugauuguacucaacauaguguguacuuagauuacuggagcggcugccugccuaacucaagacuuucaggauuucaccauguauagcuagugauccucugcugauauguaauuuauuauaugauuuuuguaguucaacuuuaccuagggaagaguguguauguguguauguguguuaggggcaagggauagcugaucauugaccuuacauguagaauaucauuuacauccaaauuagauuuuuauacacuuggaaauaaagaacaacaugccaggcaugguggcacaugccuuuaauuccagcacucagaaggcagaggcaggcggaucucuugaguuggagacaaccuagucuacaaagaaaguuucaggauagccaggccacacagagaaauccugucgcaaaaugccaaaacaaaacaaaacaaacaaaaaacuuaaauaugugguguuggauaaaauuccaaauugauguuaaauagaagugaaagaaagaguaguccuuuuauaaauugacucaugaaacuuuuuauacaguaucucuuuauuaauuuuaauuguuagguuuuaguuccaaaaauauagauaucacugucaaggagauacauauuuacaauaugugaaacuuuuucuuuuucuuuuuuuuuaagauuuacuuauuuuuuuauauauuuuaugcauaugaauacaucaccacuguuuucuucaggcacaccagaagagggcaucagaccccauuacggaugguugugagccaccaugugguugcugggaauugaacucaggaccucuggaagagcagucagugcucuuaaccgcugagccaucucuccagcccugugaaacuuuuucugaaacaugaaguuuugauaauauuuuuuagagaucuggaaaggguuaaaaguuauaguacuuucauauuaauuuuauaauacucuucuuagaagauaauucagacuuucuuaugaucacaagcugaguauuuucaaauauaaacgaggagacaauguaaguugugcuuuuauaagaucuuuauuucuagagacaacgagcaaguagcaaguuuuuguauuuuuaaaacaggucuuaagugcuauaagcacccaacagaccuucauagcaggcuggccugaacucaaggcagugcucuuaccuucgucucuccuugcagggauuacaugugagaacuaccacacccaaccucugaaacaacuacuuucaaacauacauuauaaaggcugugugcagccauugcuaauacuuauaaagacacuuucauagaaguuuaauaaaccaacuccuuccuuaagggcaaacucugauguugguugagccuauuaaaacuauuucaugauuuugguggguuaaauugauauuauuauuuuuaaaacaaccugccaaaaaggguuggagagauggcucaacgauuaggaacacugacugcucuuccagagguccugaguucaauacccagcaaccacaugguggcucacagccaucuguaaugggaucugaugccgucuucuggggugucugaagacagcuacaguggacucauaaaacaaacaacaacaacaaccccacccugcuuaagauaaaagcacugauggacuaggagcaugacgucccuaaagggaguguuagucuucuuccuucuucaugauuugcucccaaaacacuucauggucuuguuagcuuacugguauuuuugucucaguuuggaaauucuaaauuuggaaauucuaaaagaacuccaugucaacguuggucuuugcacauguugaaauuauaugaugaaucugauauuugcuuuuuuuuuuuuaaucagaucugagauucuaguaccucaaaaguuuaaaaacuguccuagaaaaguaaacuugaauuuucuuaguuuuauaugcaaaacucuauuucagcuaaaaaaacacagcuauauuuagccaacuccccaauuucucaggauuuccuaagguucucccugggugcuguaagcacacaaaagaacuguaacccagagaagcuccccgagccacggcaccguauacaaagggaacuggagcucacaaaccucucugagcucguuccuacgacuaccccccaaggaaucauuuucugaaaucuuuuucuaauuuuuuuuuuaucagaaacaauagaaaauuauuuugagauuuuugggccuuggguaaggacacauuuaugauacaaccccuagggcuggagagauggcacagugguuaagaaaaacuggcuuuucucccagagggccagguucaauucccaguaaccaucugugauaguaguuccagcagaucugacacccucuuuuggccccugaggguaucaggcuuguaagugguguacagacuuauaugcaggcaaaaugcucauauccauaaaaaaagacauaauaaauaaauacauaaauaaauauagauaacacaaagcacaaaguggaucagaauaaagugaaauauucaagaguuaaucugcaguugagucugugaauuaaagacaaauauugacacccaguaaagaaaaauaaaaugauaaguacuucugcacauaaacccuguuuucucauuucuccaccccaggagccuuugagaugcaggguguccuuguguucccauuauugugagugcuacggcuccacuaucacaguuagccacagcaaaugagaauagcuuuugacuauugcauguguucuuuuaaaaaaagaaauauguauauggucuauacaaaaauuaaauucuaggauaauucaguuuccaaguguuagcuuaaaaugggaaguauuaggaagaggucgaagggcagccaguucuaugccauugcccccugucuggcgugccuguuccuuugcauccuaugcagaacauuuuuguuauagagagaauagguccguuuacauugccuuccugugacuuuucaaggagagcagcuauuuccugggcccugaaagauuuuguuuuguuuuguuuuugguuuuaauuuauuuuauuacuugcuuggcagaagaauaaauugagguauguggagcgugggggaucugucuucugguaggauccuuuuuucuuuuagguucccaagaguuccuguuucuccugugauuuaaauaauagguagguccuuauauuaggaagcaugcuuaugaagaaaaguggcuggcaggaacauggcuuguaaguaaguuuuuucacucaguagaaaucuaagcagagauguguaugguaaguugcacugaaaugucaauuuuaacgggugugcaaaguguuagcuauuccucuuaggaauagaguauguaggaggugcuguuagaaacucagcucuuauaaaagucaacuguacuuuuuaugucuguugaugauagaaaaauauguuaaccuuugugugaaauuaagucuacuuuuguuggcuauaaugauuaugaaguaaaaucuuuuuucagguuucuuugaggagauuuuucuucucuuuuaauugugucuuuaaaaaaaaucacacaugauuacaguuaaggauaaaccguauuuucugguguuuugggacaaggaaaaaaguuaaaaacagaucauucaaaagauugauaauuggaauuuugugcagacuuugaccuugaagccuuuguuuccacuuauauuucaacacaaacugucugcucaacucucaacuccuccuccucaggugguuagccagcgcuucccucagaacagcaucggugccguaggaagugccauguuucucagauucaucaauccugccauugucucgccguaugaagcagggauuuuagauaaaaagccaccaccuagaauugaaaggggcuugaaguuaaugucaaaggugaauuauuuugauacucuuacaacguuuaauuuuccuuauagcuaauuuuucaguguuucauauucaaaguacuuugucuucauuuugcuucaguuaugugccuuuuguuuuaauuuguuuguauugcagaggaacuuuauauacacacacacacauauauacauauacauguacauauacauacacaaagugggcacuaugaggggaagguauacaagcaaauaaguaucuaauuugucuaaucagugaggguuuucuguguaacugcuuugaaaaauuugagguggaaauaaagaugcagauuguaggauuucuuuagucuuuauuauuguuguuguuguuaacagcauuugaaacugugaacaugagccauguguaaagugccuaccaugcaagcaugaggacuguggcucagaucccccagcacccauguaaaugucagggguucaugacauucagccuauaaucccagcaugcuggaggcagaggcagggucccuggaacaagcuggcuagcuagacugaguccaaauacuccaaucaugugaaagaugcuguaauauagaagaugggcaaugauggggggaaauagcgucaaacucuggccuccauaugcuugcacacauguaccaacucacacuugcaaacgugugcauauaugcacauaucacacaauacacauguaauagauacuuuguaucuauaacauguauaauaauauuucuacuugaaaagaauuaaaacaauauuuaggauauuuuuuacaauaaugaauaauugauuugaacugccaguagaaauaucaauggaaaauuuauauuuuaaugacuauauuaauuuauagguuucauauagcaaauaaucugacuacucauaaucuuguuugauuguuuagguacuucagagcauugccaaucauguacuguucacaaaagaagagcauaugagaccuuuuaaugauuuugugaaaagcaacuuugacuuggcacgaagguaagcagccagagucuucaguggccaccaugucuccauuuuacugcaguccguguaucuggucuacauuaaauuucuguaugugauuccccacccccccaauccuuucuagacuaagaccacauuuuuguucuguuuaacuuuaagacacugagaaaacucucuggaaccuguaaagcacuguuggcguuuucucacuuaggcaaugcugcagaaugggcucaagaagauuccucguauuaaaaaccauaaccaugcgauacagguuaugucagggugcuuuuauguuaauaauacuuuuguuucugcaguuuagaagugucucugaauuuaaaacaauacuucauauaccaaaauguacaaaaauauaagauuuugagugcgaagaaacagauaauuguagaggcuuuacgacugaauuuucauaacugauucuucacuuuaauucucugaauuguugguuuauuuguaaccuugggguaguacugucuuugccaggguuacuuuuuuaaaaaacaagugagaugauuccugggaaagugcuuugugaaggugcugauguucagaagucauuugccagcacgagaaacugaagggacuggaaucugcacacagccaccacgaccaagugcucagcacagaugagauuuauuucucacagagggacagagagcaggaaaugagagacaaagacaggagauagaggauaagggagagggagaagggauguuugucccggggaacagggguugggcccuggaaugaugacaaaggccugccucuggauagagaggagacagacauagcccauaggcaaauggcaguuuauaaagguaaaaaggggacacccaguguuaggaugagguguuugauuuuaguggccaaagcagggcuuuugacugcuggacuuccaauacauagauaauagucagccucaagaggaggaaguggccaaauaagggacuagaccuuaguggcuacuuuuaggaauguaaucuaacaguguuuagcaaaguagaggggauggggagaagggcaaagucugccagagccacguuugcaggcuugagcuggcagaaucccuucagaagccuagcugaugucacucaugucacgcauccuucugcagcugcccuuccaguuuguugucauacagugcuuccuggccuuuggugucuucagguagaaaauaacuauuaugacuacucacagaugguuaagacuaccaaaguuccacuccuggcucugacaggcagcugguguaacuuuaagagaagucuuuaccuaggccuccaugucuuuuaucuguuaagauacuagcuuguucuccagauuuuauccauauaaauuuauuguucuccaacuucagaagacugcucugcaguugaaguggaaacuaauaucagaaaugggaagacaacuuucuccuugugcuucucauuuacacugagggcauaaggcccccuccuuugcaaucacagcuacuauauuacuagacucuauauaaauguaaugcauaaguauaccugggguuaaaaauucuaauggcuuuguauuuuugcagguuuuuccuagauauagcaucagauugucccacaagugaugcaguaaaccauagucuuuccuucaucagcgauggcaaugugcuugcuuuacaucggcugcuuuggaacaaucaggagaaaauuggccaguaucuuuccaguaacagguauauuuuccaagucuuggggaaauuaaacacuuaguuuaaguugaauuaauaaaauuauugauccuaaauauugaucuucuauuugcacauuuuugcaguauuaugauuuggaaagagaagcgcagauucacaugcauauggcaaaacuuaacucauguuauaugauucguagcaccagcuguggaacuacaaguuccacaaucacagaugcuauuuauuaaguguaugaaaaccaagcagcauauagaaaguacccagucagucaggcacagugccaugcuuuuaaucccacugugugcaaugcagaggcugguagaucucugugacucugaggccagacuggucuacgugagcucugggccugccagggcuacgugguaagaccgugucuagagguaaggcaaacuagagagaaugagacgagaugcaguaacucaaaguauuuggaaauuauuucacuagcuuuuuaguaaaagcuucuagugacauaaauuaaccugcuguccuuugucagaguuauuuccuuuuaaguuuauauagaauuguaaagggcuccaauuucugugucugaggagaucacuguggcuaaacaucuaggagauggaaguuuaaaaguaaacuuguuaauccuuuauggaguguuuauggguugauguaggcauggacauggcugacaugugccccugaagcaggagaaggaaaggacuuuauccuggcaguacccaaguagccuggagcuuugcuuagcuuuguuuuuuguuuuuguuuuuguuguuuuaagacaagguuucucuguguagccuuggcugcccuguagaccaggcuggccucaaacucacaaagauccaccugccacugucucccaagugcugggauuaaaggugugcaccaccaccgccuggcuaauaaccuggaacuuuuaaaaaugaacauucucuucuuuuuucaugauuugaauacauaugcacaguuuguugaaauuuuuaaaugugcuacuuuaaaaaugauacauauuucaaacaugaaaauauagacaaugauuugauaguuucaugucugcucacuagcuugaauauccuguaauuuugauauaaccacuaaggaauaggggguuggggagaacacacacugaguauucagacauauaagccuauggggcuauucuuauucaaacuaccacauugcucuuccaguuuguuuuccagcacccauggcaaguagcucacaacuccucuuaauuccagcuccagaggaucugauacaaacuucuggccucauacacaaauacacgugaauaaaaaauaaaucuuuaaaaacaugauaugauaccagcauuugggaggcugaggcaggaggaucaugaguuugagguuaaccugagcuaacuauaauaagacaaugucucaaaaaaaaaaguccauaaaagaucaucaguuacuaugguuacauaggcucaugucccaaacacgguuuucacaagauagagucuguagaugagaauguuagaacuaucaauucuaaaaaacaaaaacaaaaacaaaaacaaaaaucgaacuuaaaacaguagguuuuacaggugggaaauaauuguguuucuaagaucugaaaucuuucgaugcugcaaacuuacaaaucaggcaggaacaguaguuagaagaaaagcaagcgguggcagucuaaaggaaggucagacuccccaauuaaugugaagugccauuuaauaagcauuuccuguuguuaccagggaucauaaagcuguuggaagacgaccuuuugauaagauggccacacuucucgcguaucuggguccuccggagcacaagccuguggcagauacacacugguccagccuuaaccuuaccaguucaaaguuugaggaauuuaugaccagguaaaacacaacuuugaaaggaugaauauguuuugggaggugugaaacaaaguuuauuaccaaaccacuuacugaaugugcucaugcuguauuaauauagcauguuuuguuuugcuuugauauauugauuuucuuauaaaaagaacgaugucuuacaaaaaagccagcuuuuuuuaaaacauuuguuuagugugugugugcuugcgugcgcgcuuguguaccauugccagugugaagucagagaacaaucuaugggagucaguucucuccucacaccgugucccacgggaccaagcacaggcugucaguucaguggugaguacuuucagcugcugagccaucuugcaaggucucuuuggcguagucuucauuuaauacuuuaaagaacauauagagagauaccauuauuuucauguuauaguuuuagaaaauacacuaagcagacauaacuuauugaccugaauucacaccugcuuuaugguucuuuuggauuuaaauccuaaguucuuauuaccguacuaacccuucaaaaaguccaugguucuaauuuuuuuuuuuuuuuuaguuuaagacucagaaaauauaguacacuuaaauacugcuacaacaaacauuguuuuauaucucauuuagaggacucuaaucuaucaacuaaaagauucucacuaguagacacacacuugauuauauuucacaaacaguacauugugaacggcugugaguugguuguuuuauucauaggaugugccaaugacagaaggaaaacauucucaccugauguucagaaguuaauuuauaaaaguuaaguuagacaguaagagccuacuuuggggagagagggaaagaaagggaagauagugugagaagauccaagucuguaagaagaaagcuuuguucucuuuaguaaggcuaagccuugucucucuacugcauucuccucuucuugcucucuccuccugcucugaugucacaguaaugcucuuacucucaaugccuuuucucccaaugcuaugccuuuacuugugaguuuuucuugaguucaguucugucuaaaaaguucuccuuuguccugacuaaaaaauuauccucaauucuguucuaaaaaguucuguucagauaagcuaaaaaauucugucuaaaaaguucuccucagcucaguucugucucuucucugugccucagcacuuauacaucuuuuugaauauaugaucacaugguaaaaauuucaucacaaguuuacacauaaauucaaaucauaaauugaaauagaaguuuacaacggagaauuuugacaugcauauccauuagaaguaauuauuuggcuaaacauucauuaccagucauggcuccacagguucauagagaauugaaaaccauaacuaaguuauuagugaaguuuuguauagauaaacccaguugacaucuucuguccuaguaucuauaauaaaucguaguucccuuuuuaugccuuugguuaaugguuuuacaacuuuacaacuucuuggaauauacucuugaauaguagacuaucuguuuacuaucagaagcaauuaacugguggcacaugggagacuggcagaguucucauugcaguuuugacuaucagaaaaaaaucuaauaguugcacuguaaaagagcuuaauaaauacugauacaauuuuagaauuucucauaguaucagaaagaauuaggaagucaucugucuauauagcauuacuacaagacaguacgucuucauagaucugcagagaucugcucaaaaggaugggcuaauaucuagugauuaaaauauauguaauaauaacaggagaagcauaguaauagcaggaaucucuccuaaaauuauuuucuucugagcugugccuucgggagcaaauauguuguggauuauauuaguccuccgaggaacacuaucucaggaagaucaccugcuaguuauuagcuuguccugugaugaauucugacacuuucucaccuuucuaaaaaccauaaaugagaggauugaugaacugaacuugcaaggaaaagcaaacuaaaaauccuuuuaucugaaaaaagaaguagcauggguaaaaggcgagcaaccaccaugcauguccaggggugguguuaaguaaucccaagagagucauccugacucaggaacacaccuugacauuuugcccuucagaaaacugguugcuuuuuagguauuuugcuuuuugguguuuuucuuuuuauuguugauuaaucacauuuuucuuuaacuaggcaacaauuuguauaaagacucuuaagugacucccucuuuguuuuaggcaccagguacaugagaaagaagaguucaaggccuugaaaacguuaagcaucuucuaccaagcuggcaccuccaaagcugggaauccuauuuuuuauuauguugcacggagguaagaauacauuuuagucucuuuuaauaggguuuuucaagugauagcaauugcagaaacgugaugcgauuuuuuuuuuuuccuucuugaauuaauagcccuuaaagccaugccucccuagauaguaugcuuacuacuagguauuuguuugagaguaugcacuucauaugucuuugcuacaucagauguuaaggcaccaccacaaggaguuacuaucagagugaaaagucuuucggguauauucugauuuuauaauaucugcaacacaaaaaucagaacccucccuacacacacacacacacacacacacacacacacacacauuuaagaagaaagaaaagcuaguauauuguaugagacuguaucagagcaauuuuaucagagcgauuuaagaaagaauuacuggagcuauaggaaauggcuauaaagauggauaggguggccugggaaauagacugugauguccucagccaugccaugagcuguucuucuuccucuuccucuucuuccuucuccucuucuuccuccuccuccuccuccuccuccaucuccauggugaugggcuugccuugcuuucccugccaugugaaaacuaacauguggugguacuugguuaggcucucuucuucccaugagaauggcacaacccacaguggcugaacuuggacaaaaagugauacuacauaguggcccaugauaacgagauguuaagggcaguccagcagcucuaggacuuagucuucucaaacuuaacagaaauaaaggaauuauguuuauugacuauggucaugcaaaaacguggcagagguugagaaaucauacaaagcaggagaaggaagaagaaugagaaacgugaaacuuuuuaaauuagauacucagcuguccagaguucugaguaacuggggaauagaaaaggaacaggaaaacacgcuuaccuuuguccuuuuuuuaacaacuuuaaggaauaucuucuaauucuaggcaaauguguuaguccauuuuuaaauauagcauuuaagaggccaaggcaggaggauuauauugaauuagaaguccacccugggcuaucucaaaagaccucucccaaaaaaugggaggaaaaaacgacccuccuuaucucuccacaaaacuguucuugucuugguuguucuuucuaagauaauuuuaguuuucugucuuuuuuuuuuuuggagacaggguuucucuguguagcccuggcuguccuagaacucacuuuguagaccaggcuggccucgaacucagaaauccgccugccucugccucccaagugcugggauuaaagugugcaccaccucgcccggcaauuuuaguuuucuauugcauuucagccuuguugguauuucagcuuuaaccuuuaguacuaucaggguauuuugacuuuucccugcuauaucuaaguugugaggacugguaaggaguguguuagaugugugccucacucccagcccccuuugaauucuuuguaguuuaaagguagcagaauguuggauuuuaucuuccccucuuuaugauaaggaacuguaaguuuguggccuuuuucucugguggccuagcagaggaaaagcagauuggccuggccuuucgacggguuuccacagcucuaaaucaggccugcacaccuuagguuugcaguugccagggauccccagucugcggcuuauuagguguucugacucuucauuuuugagaaggaagaaaauaugcuugcuaaacuucugugucucuuucgguguaauuuuguaacaaacugaguuucguguuuucuuuuucuggauaugauauugccaaaucaaauuuucaguacuuaggaguuuuaguuuuugcuucauguuuugaaauguggccuuaccaaguagccugucuggccuauaacucaagaucauucugcuucagccucucgggugcugggucuuugggggcuuuuuuguuuuuguuuuuuaaauguacaugaacaugcuugucuaucuguguauccugcugccuucaagaggcuucccuggagcugacguuauaggcaguugugagcuaccauggggguguuuggaauugaaccuggaucuuuuggacacauagcuaauucucuuaacugcagagccaucucugcaguuccugagugcugguccuaaagccaugugucaccaugccuuuccuuucugagaucugggagagcuucugcucucacuuucacuggguacaaugccuaccugcaggacaaaggggcacagugggaagagcagagagaggcccuguuucucauugugacgguaagugaaggccuuaucuguacaggcuucugugacaaguggcucuggagucuggcuucuuuggugucuacagacauuugaagucuaaaugucuuuuuggccucaucuucacaucauguguucuuucccugucaucguaagacucuccuuuucuuuccuccugcccucugugggaggcaccugugaaaucggauggauccgcugagguauuuaguguaggcuuugguuauuaccaagucucuuauuuuaucagaaagugggccuaaagaaaaccacgagucaagagccauaccaggaagaaacaucacuaagccauaauugcugcucuguuucuuggcuuuguguuuaacuccauuacaugguucucugauuucugugucauuucagcuuuagcucagccagugaccccuucauuaccucaauauagcuuaccugacguucuugauaugugguucagcuggaaaguaccucaguguucaucagugacuguccuuacauacagguuuacuuauuuuaaauuggaucuucaugaucuauucauuaucuaguauuaccaucuguuacuuuugaaaugucuuacauuaaguuuuauuuauuuuuauuauuuuauuuauguauaugugugaguauauacacacacauaugcauauacauggaccauacacacacacuccccuuguguaugccuuaugaccuuaaggacagaaagggcuguagcugucagugguuuguagucuuccagccuaaaaagcccuugucacccacuugaguagcaccucaggcuuuacuggcuugucuugaguuucuugucaguuucuuagacugucacguuagcaaggaacauggauuauuugguucgucaggccugggucaugagcuuaugcuuagagcucagcagugcauggauggcaauaguauauuucugucauuugccucguguguguguguguguguguguguguguguguguguguguguguaaguguaauuaaaauguuaaaaccuaagcauuucaguugagaguuuccucuuugggauacugugauuauucacagcuguuuggaggagggcauuaauacaaauuauaauucauauuuacuuaauacuuucuucacaucaaacuacauauuguauauuauauaauuuuuuauuucaucccaauauuguauaauuuuuuauuucaucccuaucauaaccuucugagguauuauuugcaaucuuugacaugacagaaacucaauccugguuaucagaaaaaucuaaauaacagcauuuucuaagcccccugagcuuccacaucagaaucuaaggacaaggcuucuuuuuaaauuuuuucauuaauguaucuauuuauucacuuuacaucuggaucacagcaccccuccuuccucuccucuuaguuucauccucacaaaucccucuccccauuaccccuuuucuucucugaggagaaggggagccuccccuccuuggguacuaccccacccugggacaucaaguugcagcaggacuaagaacauccucucccacugaggccugaccaggcaguccagauagggaaggggaucuaguggcaggcaacaaaaucagagacagcccaugcucuaauuguuaggggacccacaugaagaccaagcugcacaucugcuacagauguguagggggcucuaauuccagucccugcaugcucuuuucagccuuccaugggcccagguugacucuguauaucuuucugggguacccuugaccccucuggcucucucaguccuauaccccacucuuccacaaggcucccccaacuccuccugauguuuggcugugggucucuguaucugcuuccauugcugcuggaugaagccucucaggagacaguuaugcuaggcuccuaucugcaagcauagcagaguaucauuaauaguaucagggguuggcucuuucccaugggauggaucucaaauugggccagucagugguuggcuguucucucaauuucugcuucaucuuuaucucugugcaucuugugggcagaacaaauuuuggguggaagguuuuguggguggcuugaugccuccauccauuggaagucccacugacuacaggagguggccaccucagucuccauagccccaacugcuaggguugccccaauagacuuugggagccuuucccaaucccaggucucuggcuagucccacagaugccuccccgcuaauuucugucuucucuccccaaacuguccugccccuacccccaccugauucccaucccuguuccuugccuuacucuaucuccuauccaguucacucccucugucuaccuccaaugucuguuucauuuccccuugugagggagagucauauauccuuggggacaaggcuuauuuuguauauuuaaacuggcacucccaaaugacccaucuguagucaguccacuuggguucugcugugucauuuuacucuugauagcuuagcuaguuagaauugucacugaguuccaaacuaaucuuaaguuguuuuuuuuuuuuuuaagauuuauuuauuauuauacauaaguacacuguagcugucuucagaugcgccagaagagggcaucagaucuuaaugggugguugcgagcuaccaugugguugcugggauuugaacucaggaccguuggaagagcagucagugcucuuauccauugagucaucucgccagcccuaaucuuaaguucuaacucaccaugucaauaacugcaggaauuguuacuguuagcauacugaguuuguuaaguuaaacccauucuuguauauaaacauaaaaaucuagccaauguuucuuuagucucaguacucagcccaagguagaaguaguugagucucuaguuugaggccagccuugucuacauagucaguuccaggacagccaggacuacguacagagacucugacuaagggaaggagagaaagagaugggaaauggacagaaggaaaaggauggaaaaagaaggaaguggggagaaggagaaaaggggaggaaaaaaaguucagcuaacagucaagagacauuuuccuagguaaaaugaguucuuaguucuaagcaucugauuugcaaacaaucuuuuggaaccaagucaauauuuacucagaauacguuccuauuauuggaucaacuguauucugcuuuaaaaagguccuggaaugaucuacugcuaucauacuuucaugaaaguggugucccacaaauggguauguuuguaaaagacuguuguuuauacccuauuugugcuauucagucuauuuaauuaaaaauaauaaaauauaaaacagcuucagcuucccccauaccucucuuuaucucccagcuucuccugcccccuugcuuaaaugccucuuccauaauuucuucucuuaucuuuaauauagacauuugaguuugauucuauuuugcaaacauuuaaaacacaaaugugauguuuugcuuauuuuggcauuuaauagagcacugcacauuuauaggaaggaaaugauuauauuaauguaacauuuaaauuauacaguuaaaacuugccaugguuggggauuuagcucagugguagagugcuugccuagcaagugcaaggccuuggauuugguucucagcucaggagggguggggagugacaaaacuugcccaaacccaaaucuuacuagaauaauaauuucuuccacaguaaauuaauauaaauuuuauuuucuuagugugcuugucauuuaguaaauaauaugaggugcugaagugagcaggcauuugggcucauuucugccugaguauguacaaaagaguaaaaauacugcacagaaaaagggagugaguguugaagacuggucugagugccgugcucccgccugccacagucccugcagucguguuuaugcagggacuugaugaccuguuuccuugccaggugcucuuggagaugagcuccgagggcuuugucccaggauugaggcuuggucuugauauggccugugggcuccugggggaagacgagagcauuccaggacuuggguuucuuguagaauuugaggugguaguuguugugguugugguugugguugugguuguggucaucccaagacucaaguuuuuuguagaauuugaggugguauuuguuauuguuguugcugcuguugcugcuauuguuguugaaauuguucccauaauaugagcacacaugaggagcagggugacagugaaggaaugcuuggucaucguuuucuuuugcuuuaaagugaucauaaaauuuaauacucaguucacaaacacauagacaaucacauaucuuuaguuguaucucuauaguauauucacauaauauaaauggacuuuuaaauuauucauuaaugaccaaauaacaacccuccuuucugaaccucacccgauaacagacuuguuuucuaucuaggucacuaacuucaggaauaagcguucugaauacuagaaggagcuugauuuuguuuuccuguuuugcaaacaaguuaaccaugaggcauuugaaccaguaagaaugggguuggugugaggaacaggacagcagcaaagguucgaccugaaggacuggcugacagacugggugggagaggagaguagcaggaggaggaggaagcuucucgcuuaguaguuuaagggguagcucuacaaauuagaauauuacuuuuaaaucuuuacaacaaaguagaagaaaaaaaccaaccauaagucaaaugauuuccccaaugcuaagguuuccuucauuuuaaccuucuuuagggguagaagagagcaaagggcgagcuguuaagagaauuccauagcuuuuuaaaaaggaaaucuagaauugacuacaaaugagucugccauuuuacagcugagccuacacgagggguacauacagcaugucuagagaugccuauucuacaguaagcagacugagagccugagucugaauccuaguucagguucuuuagccgguaugaaugguaacacagagcaggcuccuauaccaaagggucaguacucucucuagaauuaggcuacuuuucucuuagcauguauucaaaucuaauagcuugcuauaccuguaauaagcagaccccugcuuaccaugauaaaauauuauauuuuuuguucaaaucuuaaacuuaaauuuuaggaauauauacaagaacuucuauuucauucuaauacauaguuaaccauuuucgaguuacuacuaccuuuugauuuggcagacuaguuuugaagauuaugaauucagccuuugucuuggguccuggagaaugauccugaagggaagucucuucucacucuccgaguucuaaauaauauagcuaggagccagucacgugcuuggagccucgccucuuuggaaguaucggaaggagcguuuccaaacaucuaguguaaacaggcagacuuugacagagauuaaggcauucaaauaaaaucuuuguaaagucuauguacuuacuuaaaggauccagugaauaccucacugcauuuaaucuuccugcaugcacccaaauggauugcuucauuggguugacucuaacuagacgaauauauaauuugcuuuguaauuaucaugauuucaaaccaaguaagagcauuaaugaugauuuuaaaauaauuuaggaauuuuacaucuuaagagauuaaauguugauaaauaaagauaaaaguacccucgcauggcacuuuaaagaaagaauuagacauggaagugauagugugagacucaauuacagaaguuuccuuuuaaaaaauguccuaagccaccucucucacgagcugaagucaguguuuuccggggaaauagggcuguguuguaguaacagcuucaucuucauggcaggcaccgugaguguagcaggaauggacacaaggugugguguugguacacaaggaagucacugcgagaguggcggggaacaagccaguacauguccuuacucugugcugaguuuuuccccuccuuugaaugaauaggcaaaugcuugcuaaaucucuaaccucacuuguggaggguaguugugaucauacuuagaaaaucaacaaaagaagccucuuggcaaccagagcagugcacuaagucacugccugagauagugagugucugcuaccaugccucuccuacucccugcuuauucugagaauugacucuagggaauagaguugaaaugguuguagugauguuuacuccuugagcuaacuguggcccaguaauuaauuauguuuuucuaacccugaccuuuugaauuuauucuuuuacuccuccccgccccucuuugagacagaaucuucugaacaucuggccuuaaacucaccauccucuucccucacgcuuccaagugcucagauuacaguguggccaucaagucugccuauucagcuuauuaucaagcuucuaacaacucaaucuugccuuacuuacuucaguguuuucucccuauuuuuucucagagucucuuuguuuuguuuugcuuuauaagauagggucucauguagcccugggucuucucguaaucuguuaauuucauuuaucauuuagccaaaugacuagcugucuaaccuuugguuucucacuaucuuauuuuuuuuauuaaccuuaaugaugcuaaacaaacaaaaauuauuuaccauuauccagccuugaaagaccuuaauauugucauugugucugaaguuuuuuccuuccuugcucagaguuccuccuguggaggccuaccucugaugucaguacccuuuuucuauguaugaacaugcccuaauuuuauggugaagaauuagucauuuuaggaaauugcaguuaucagagucuggguuuuuucuugcccugccuucaggucaagcacaccucuuauucuuuguauuuucucuaccuucuagcauaguaaguauuauuaagacuaggagacacugggauuuauugaaaagcugucaguuuauuucugucucuccaaugauaugauuaguaaugucugaaguagcaacuauuggucauuugacuuauuuccucugugucauaaacauacguucacgaaucaucagccuaaauuuaagagcccacuauuauuuucuggcuucuauuugguaggucauauauacacucaucuuugacaaccuaaaguugaaucaauagaaguuugacacucaaauuauuuggaacauuuuaccuggguugguaugagacuuggacuugguauauuugugcuucuugucuccuuccagcauaucgccauaccacuccugucagccuugugguuaacuaccugggaauguaccugagugcuggugacaugaguugugugacuuguccugggugaccuauuuccauucacucuagacaaagagggaaaugauagaccgaaggagcuauucuuccaaguugugcuaauaguguuccaggagcaucagugacucagugugcagcuucaccaaagcccuugucuccaucagugauggaucucagaguugcaugccuggagucuucucccuccagcaacuacuuaccccuagcauacccuucgggacagggagcguggcuccugagcauuccuucuguccacaugagaagguuaauagauccauuuucaugaggguuaucacgacugaucugaucaaguugacaaccaucacauccagcccagagaaaacaauauguacaucauuuucuggccugguguuuggcuuugaaccaguucuccaaaguuuguuggagggcuucuucaaaacccuagaagagaguagaacuaaaugacucaguagaggugagaaauaaacuuuuguugucauagcuggaaauacuugagggcuguuuauaauagaaacccaucugugcuguuugccaaaucccauguuacucuacuuuacauccugcuucuaccugagauguggaucugaauacagaaucuuauugaacuuuucucaucucugaauuccacuugacuaauagggaauacaaggagacugaagaaagaaaggguaggugagaauguauucucuuguucaccauggcugccugcauccuuccacgagaugaugguuuuguuagguaauccccucucuguauuuacuuucugguaacugcucuacuucagcugguauuucuaacuguuuuuguaauugucuaaagcccugccuuauccuuuucauggaaucucuugggucccaaauugaguuuucuaccaacuagaauuuuacuucuacagauuauguacuguaucuucuucuacacucaacuauuuugaauucauaaauuuaucuugcucugaggauuucaaaucagggucauagauauacacuaaauuugaagauuuuuguguaccuucuuagaaugaggcaccauucauuuaagaauauguuaaauccuuggguaugaugaugcaugccuuuaauuccagcaucugggagguacugggagguacugggagguagacauucugaauuugaguccaggcuggucuacuuaguaaguuccagaccagucuggccuacauacugaaauccugucucaaaaaccaaacagacaaaaaccauagcucagcaguuaacacuugcuccucuugcaaagggucuccuuugguuuccaacaccuacauggugccucacaacuaccuguaacuccaguuccagggaaucuggccucuauagacugcuaaauguacaugauauacacacacacacacacacucaccaagaaaacacacacauaacauaaaauaaauaauaaguauuuaaaauugcugaaaaaaaucugguaaauuauguguagaggugagagagagagugcacacacacacauguggguauguguacauuaguacaggugcucucagaggucagaggcaucccuggagcuggaguuauacguaguuaugagccaccugacuugggugcugagaaccaaacuugaguccuuuggaaaggcagagcauguuagccacugaaccaucuaacccccuguauuaaaagcuauaucaugcugcaaguguguaguuguuugguuuggguuuuauuguuaauuuauugacuuauuuugagacaagauauuacuccugcucagaccaacuuggaauucccuauguaggcauuauugacuuugaacuuaugggagcccuccaccuucugccucuuaaauguuucgauuauaaacauguacugcgaugcccagcuuauaaagaauuuuuacuuauauuuaaaaguugaacauuuaaagcauguugacaauauauagcacagaaaauggcuuuugguguuuccuguuuuaaagauguauuucugguuuuucuaaauauguguaggugcaugugucuguguggggguauaugcaugugggugcuugugcucaaggaggcuagagaagugagaucuggagccuggguucuagacaguugugaacugccugauucgagugcuagggacucuuccucacaaguaacaugcaaucguuacugcugagccaucucuugagaacaguauugcuuuuaaacaaaggauuugaaaauuucccaagguaguagauauacaacuaucccaaaaggcaggcugcuguuagauuuaauucuuaguaacauuuucaauugcacguaaaccaccauuuucuuugguuuagaaauauaauacagggaaaagacaugcuuccccugguuuagauagaucuaucuuagggccagggguauaucagucaguaaauggcuuuccccgcaugcauaaugugaguuugagaccagcaugggauauguaagacccuaucugaaaaacaaaacaaacaagcaaguaaacaaaaagaaagcacaaaccacacauuccagagcaagucaccacuuccaagcaaauuugguuuuuaccaguguaaaccuguaaguuucuagucuuauuuugacuuguugugacuuguuauucauaaccaauguaaacuagcucaguauuuuguuaaugucaugcuaaaagacuuucaagaaagcauauagccagggaugauagauacauaacucauuuucagaauuaaaauuuguuggaaucaugaauacagaaacaaauguggccugaguggaucuggguuagaguacaguucuucccucccauuguucccuagaaaaccaaaagagacacugcuugccaaggccacauuaccugugcucuccugaccacagcccauaacauccuagagucauuaagcuagacuagggcuuggaaucagaauuuagcaugacuugacuuugaaaagauugucuccucuuuuucauucccuuguggaugacaguauuuccaucucuugagcuuuaaauaaaguuaacaucaucuuacuaaacuaagucuuguuuguucugcuucagaagaaguuuaugcugcauucccuauauuauagacucacuccgcagccccacccauauucuuaucugcaaugugaagaaccauguagugaauguaagaaccuuuaguagcuuguuaguauuauugugcagcagcuauguugcgcugaccucuaggcuguugcuuuaaucucugcauccuugcacauuucuuccagaauguccuaucucucuauggccauggcuguguacuuccagguagaauguuuuauuuuauguacuauuaacuaagauuuuauacauaaggcauuuguuuuccauuucugaggguuuuccauguccucauagcuaucaauacuauuauuuucucaaaacuuuuuuuuuuaaaggaaaauguauguuaugcaugaaaaaccaggaaacaaguggcugagaguuaugguacacacguuuaaucucagcacucuagaggcaaaggcagggcaaguagauuucugugaguucaagucuauccuggucugcauaguaaagcuguaggccagcccaggacuacauagugagaucugucuuaaaaaaaacaaauagauaaaguguagaaccauuaucuaccuccuuuuuauaccauccaacauguaugugccacgcuuguaaacugugucugauuauaaacccuucauccuuagcaucucauacacguccuacauagcugggcugcucaaucugcucauaaaauagcuaaagcagugucaaaaguuguuugguaaggugcuacaugcuagcuugucuuucuggaagucugucgccuaguacauguaccugagcuuugacaagcuauagaagguaucaggccaguugucaggaagacgcuagagcagugguucucaaccuguaggucgugacccucuguguguuggggggugccuaucagaucuuguguguauguguguguauacauauacauagauauauguauauaugaaguagcaaugaugaacuguucaugguuggagucacuccaguauuuggaacuguauuaaaggaucacagcauuaggaagguugagggccagugcccuagagacgagcuaagcagcagagucugcccauagacuuagaaugcccaacacacauccuguguaucauaaccucugcugaagugguaauaaaguaguuuuaaaacuguuuucaucuaguguucaugucaugguagaagacuuguuagucaucauggugaguagagacaucuguaaacgaauguuccauauuugauacuccaugccucacauuuugcuccacuucuacaaaccaucuuacccucugcuuacccuggcagucugccauguuuaccuuuaauaagggcaaacuugaacuuuucacucuugaguccucuaagcagggucgccaccuccucaaauaagauuguauguaugugucacagauuauaaaauucagccucuuaaaguccauaguuucacgauuguagcacauucugaguuguacuuucauuacugcuaguuuuuuuuuauuauuguuuuuuauuuuauuuuuauuuauuuuuuaguauauagaauagaguuuauucaggacauggggaacggaguugagaggauaguagagacagacaggagagaaguagagcacauguagagggggaagggaauggggagagagggggagcagggagggagaggacagagggagaacaagaaggcaagagagcaagagcgagcacugcuagucaguuuuaaagaguuugaucaccugccccccaaauaaaccuuaaagccauuagcaagcacucccuuuccuugcaccugacagcuauugaucuucgugugucucuguggguugcauauuguagauacaucauauaagugaauccuacaguauauguuccuuugugacuucacacgaauuuucaagguuccucugugaugucucauucauauauauauauauacauauauauaugaacauauauauauauauauauauucacacacauguauacacacacacacacacacacacacacacacauauguacugcauuucauuuuauaucugaccaguauuccauuguguugcuauaucacaguuuaucuuucuguuauccgguaaugaauuuuucuccacauuuugaucacugugcauagugcugcuguaaauaaauauaugugguuuuguagggucuguguuuucagguuuuaaauuauauaucuagaaguggaguuguugaaacauggugaucaaauguuaaccucugaggacuaacuuuucuaagguacauaugccauuguauuguccuguguagugcauaagcauucaagaaucucugcaccugaccaaaugcuugcuguucccuguuugucuaggcaaauucugagaaaugcuuccucuaauccacaguggguucuauuacuauuuuacagugaccaugacagaauauaauguuauguuucuauguuggauguuuaguuccuagguuuuacauauccuuauauacccagaaaaucuaguauagagaugggauuuuacagagcaauuaaauaaaccuagauuuuguuuguuguauuuuguuuuugaaguggggcuugcuuuauaacuuaguuuaaccuugaacucaggauccugacucugucucgcaugugcuagaauuacagguuuguaccacuaagccuaaucugacuuguuguuguuauuauuguuuguuuguuuugguuguccaguguuucaagacaggguuucucuguguagcguuggcuguucaggagcucacucuguauauaguccaugcugaccuugaacucagagauccaccugccucugccucccuaguccugggauuaaaggugagguaugcaccaccacuuccuggcuggagacuuuuuuuuuuuuuuuuuaaagauuuuuaauuauauguaaauacacuguugcugucuucagacgcaccagaagagggcgucagaucucauuacagaugguugugagccaccaugugguugcugggauuugaacucaggaccuucugaagagcagucagugcucuuaaccgcugagcgaucucuccagcuggaguuguauuuuugauuacacacacacacacacacacacacacacacacacacacacacacacacacacacacacacacauucauugguaguauuuaaacuugucuaagauucacgcucaucauggucaacuuauuucgaucucaaaucuuuaaaaagagaagguggguggugggggaguggaauugaaguucuacagagauccagaggaauucuuaaaugguuuucuuuucugugauacuugguuuguagaaacaguugccauggugcucaguugcauuacuucacagggaugcuuuagugauuaaugcauacagacugaccuggcauuaguguuuauagucuagcugcugcucuguaaagauaggugguugaaucuacuuucuaaugcauccaguccuugaaaguaaauaauccuaagaauauuuucaagguuuauuuaaaaauauagagcaccgggcagugguggcgcacaccuuuaaucccagcacuuuagaggcagaggcagguggauuucugaguuuggcgccagccuggucuacaaagugaguuccaggacagcuagggcuacacagagaaacccugucucaaaaaaacaaaacaaaaaauauagagcaaguaugugagaauaaacacagcuggguuaauauuguucucuacaaaaagagucacuaauagagacaauguacuucaagcuaugccaccuucuaacacaacauuuuaggggaggaggaguguucuuaaaguuuaaagcacauucuuuuacaauaugauagaaaaacauacuugaccuuuuuugguuuaagaugacaaaauaccaaguuuaauauaguuuuauuuauagugagguuuguucuuuuuuguuguaaauuaaaaacugccucuugggcgcaugccuuuaaucccagcacuugggaggcagaggcagguggaucucuugaguuugaagccagccuagccuauagagcuaguucuaggauagccagucugggcuauucagagaaacccugucucaaaaaacagaaacaaaaaauuaaaaacuaccucuuaaaugguuuuguaaauccaauuauggauuuauuggauuaaguaaaaacacuuaugauugcuuugaugaacuauacuuaaaauccauuaaaggucauuuuaugauuuauaugugaaaauauuuuuccuaguuuuaaauaucuccuuaauucuccaaguaauuuguuuuuuuguuuuuguuuuguuuguuuuuuuguuuuuguuuuguuuguuuuguuguuguuguuguuuuguuuuguuuuuguuuuucgagacaggguuucucuguauagcccuggcuguccuggaacucacuuuguagaccaggcuggccucagagauccaccugccucugccucccaagugcugggauuaaagccgugugccaccacgcccggcuuguuuuuugcuuuuuaaaaaaccuuggcuuuuacaaguguauauaaguucauacuuaauggcuuauagcuuucugguacaguuuaaagucaggacaaagacuuagacucuuuuaugaaagcaagaggguuggguaugguggcauaaacuuauaauuccaacauuggguaggcugaggcagagucagaaaaugaauucaaagccagcauauguuauauaggagggccucucuuccaaaacaacaugaagcaagaaaagauuugauguuuucuuauagaaaagcuauaccaugagggaauauuagccccuacuguucgaugaaauuauuuuuuagacaaugacuuuacuuaauugccauugguaugaggaaguacacaagugucuacacaauaagcuggugaauggcuguggccaugcgccagauagucuuaugcuauauagugcucagauguguuaguggucauugaagcuuugguuggcaaauaauagcuuucccagugguuauugugguauauggcaucuuuguuuuuccuuacuggugguuuggugucuccuccuccucucuacuugaugaaaagccauuaaaucugagcuuauuuucuguugaggcaaguauuugaaagucauucaaacucccucagcuuuugaagugcucauuguguugaaacugugacuaugggcaacaaaauaaugcaaaauaaaggguuguguuuccuggugugauuagucugaugaccugaguuuagauccucagagugcacagagugguagcauuggaguacaucuguaauacucaacauuccuauugaaggauggaagguggaaacagggagauauccuggaagcucacaggccaguuaggcuaguguaugcaacauacaauaagugauacucugccucaaacaauguaguaggugaggaccaacacaugagguuaccugaccucugauuucuauacagauguacagauguauacacaugugcuuaaaguuaagucauauuuuuuaugagauaaacaauaagucagcucuuugaaguauaacugugaaagggaaacuguaugccucaugaguucaaucauaucucuuucugagcucauuagugauccaaaauuacuuacacauuaaaagguauauguauagacagaugacucagcaguuaccaauauuugcuacucuuccaaaggaccuagguucaauucucagcaccuacauugcagcucucaaauguuuguaacucgcauuccaaggaguccaaugucuccuucuagccucauuaaguacucggcaugcauguggggcauacaguguggugaacaaaauacaugcagcagaacacucgugaacauaagacagaguaaacugucuguaauuaaaacacaaauggucaauacauuugacuugaguucuuuccuuguguguaugugucugugcaguuaugcacauaacaugcagaggccagaguugauauuggauguuguuuucuauuacuuucuaccuuguuuuuugaaauauggucuuucuuuggcccugaagcucacugauuugacuagacuugcugacuagacaaguccccaggguccuccugucucuaucucuuagggcaaguauuacagcacacugcuauaucuggcuucuuauauaggugcuggcaguucaaacucagaucuucgugcuugcucagaaagcacuuggcugacuguacuaucuucccagaaccuaacuuauuccuuaaaauacccuuguauaauauuucuauauuucucuauauguuauauauauauuauauauauauuucuauacuuuguuaguaaccucaacaaauccagaauugugacccagggauucugaugaggaaacauaaguacguuucuccugcauuuugccacucaguucuucagcacauuuaacaaaagaaagacaguugagccaaaauggcauuucuuaaaagccgagcuucuuaaagaccucacuuuacacugcaguuuuuagugugugaaacaaaugaaucugcuuaacacauuaauacacugaggugacauuagcuuucacucccuggcagacuacauuugagcagcuugccuuacuaauuguucaggaauuuucagaauuaaugguaauuagcagcuaucuggaauuggcucacauguaauccuacccugcccugaacuaguuuuuuuuuuggauggcaaauaauagccucuccagagccuucauucugguuucacuuuccccucugagaugggugcucuugcuacguuguccaggcugacuuggaacuucuaaguagcagauacucuaaguacauuccauuacacuugacugcauucauucuuaacuuuucccuaaugucccuccggacuuugcuuugaccuaaauggaagaacuguagauucuagaguagacucugcguguccuaaguaggucauuguuugugcacuggucacaucuuugaucuguucuuguuccuuagaaauucagauaaagauaguuaauacaagaaacuuaggagaaauaaaaucaaaacugaaauacaaaggauaaauaggguugcuaguguaagaaaggggacauacagcauuccuaaacgugucguggccagagagagcauggugagagaagcaaaggaagucugguuugcucgggcuacgggacgcuguaugaggaugcuagguucugagucauggccaaguuacuguccaaaagaaucaugccagugugugaauguggucauuguauugucuuuucccgcacugauuuuaucccauacguuuuuaaguuugcuuguuauuuuaaagauuuuuaagauauuacauuuuauuuuuauugugucucucaguuauguggcuggccauauuuucauauuaauuaccacguuuccuguguuguaaacagucugcuuguguccuuuacucagauaccuauuggaagauuuuuauuauuuuuaauauuagcaaucuccuuuauaguauucuauucuaauauuuuuaucagguuugauguuucaacauaaagaauucagaagguuugacugacaaauuuauuggcaaucucuaguucacuuuaugguguguaucacaugaauuaaauguaaaauugaagugucuuccaauuuucuuauuuuuaaauuuuuauacuuuuuaauuuuaauguauaugaauguuuugccugcauuuauuuaugugcacuacaugugugccuggugcccgaggagaucagaagaggguaucagauccccugaaaguagaguuaaggaugguugugagcuaccuuuaggcccuaggaauucaacucagguuguuggcaagagcaacaagugcucuuaaccacugauccaucucuccaagacaugucuuccaauuuccccagcacuguaccauugaaucuuuccucaucuuuugaucuuugcuucuuuuuuucucccaaaguuaacaauguuuaagaaaugguaugugcuaggcacuauuuuaaaugcugugucaucuuauuuucuuccuguagcucuucuacuuugaggcauagagcuaauuuuuuaauauuauaaaaccaauaaaagcuuuuguugguugggcaugaaaauauaugcuugaaaccccaaagcugagagaggaagauugggaauuugagaccagccugggcaacagagugagacccaucuuuaaaacgugguuaaaaaauauuuuaggcacaugugccaaaacacccauacagaaaaaggugaggaauucuuucuuacauacgcucuacuaauuuuacuuuaccauuucuauauuaaugacugucuuaauguguguguuguuauauaugugugugccucuuggcacaugcucugcuacuaagacagacuauagccccucuucugucuuacuaugauugauaccaagguauaucuagcauuucuucuggguuuagggguggauuuuuugccuguuuauuuuuccaaaugacguaaguauuuuauguccuauuuuaaauucucauugaagugcuugucaaaaaaaugcuuaaucauuggcuggagaguuggcucagugguuaagagcaccgacugcuguuccagagguccugaguucaauucccagcaaaaaugugauagcucacagccaucuguaaugggauccgaugcccucuucuggugugucugaagagugacaguguacucacauacauuuaaaaaugcuuaauuaucauauacugucaacaacugcaguuuuauggcaacuagucaagauauguauccuauucauagccuuugguauguuccagauacuagcuaaauuugguugagggaaugaauaaauugggacaucugaacuuguuaccucgcauuaauguuuucuacauucacccauuucuguguggauauuauuuauuuggcauuauaguuuuuucuuauaguuuucuaauuauuuucaccaacauauggagaagucauguacaucuccacauuuauuucguuaguuuuuuuuuuuuuuaauuuaagguuauguuucugaaaguguuccccagguaucuuuucaauaagcaauuacuuuauccguuaagaauaaauuuaguagucaggcagugguggcgcacgccuuuaauccaagcacucaggaggcagaggcaggcgggucucugugaggccagccugggcuacagagugaguuccaaaacagccagagcuaaucagaguaacccugucuggaaaaacaaaacaaaaagaauauguauuuaguuucuuauuuaacuaaauuguuaucuguuuguguauuguucuagaauacucaaauuaugggauuuuuaaaaauuuaaauguacuauuuuucuuuuauuuauccuucuuuauuauuuguuuguuuguuuauuagauuuuguguaugacuacuuugccuguaggguauauaugcuuaccauacaugugucuguuacccacaaguucagaagaagguuucaggucuccuggaacuauaguuaugaauggcuguugugagcuacuuuauugaugcuacgauccaaaccuaggcucuaugcaagagaaacaaguucucuuaaccacuggggcaucucuccagcccgugugugugugugugugugugugugugugugugugugugugugugugucagcacauauguggaggucagaagacaacuacaugaaauuucuucuacccuugcauagguuucaaggaucaaaccuaggucuuuaggauugcauacuaagccuuguuacccauugaaucuuccuagcggccaaguacuguuuuacaggguggcuaaaggugcaagcucucuguugugcagcugagauuugcaguugcuuauccucuucagggggcuuucacaaugcucuagucuugugccaguuuuacuaaaauugaugucugugagacauaguuaaugccaaguaaauauuuuuuccuccguucaaaaugagaccaaccaaauaaaaauauuguuuuugucaguuugauguaaacuggugguuuaguauucauugauaucauuccuuaacuuacuuauuuuggagacagggucucucuacauaacccugucuauccuagaacuuaguguguagaccaagccagccuugaacucacaaggauccaccugccucucucugccuuccaagugcuagauuaaagguaccacacuuggcuuuuaauuuucuuuauacauaauuucucuaguauaaccuuauccaggauuuuaggugucgcuucucugacuucuuugguauccauuacaguaauuugcugucgauucauggcaucauuauacaagauuuaauaacacaugugaauggccaagacacuaugaaggcuuuauggggauuaugucaggagaaacauuauaaugucaacccauuuccuagaugagacuagcuuagagcagugagguguuuuguugauuguacagaagugacagagguaaauuacuuacccgacagaacauagccucagggguguguggacauauuaauacagaauagagacucuuugacuugggauggacuuauagaucaauaaaaaucuuuguuacuugaugacauccuaaauugaaaauguauuuaauacaccucaccaauuuauauguacuuaaaacccuuaaaugacuguauaauuggccaagacauuuaacaaaaaaauugucauaagucauuuuacaugcugacguauaccuguacuuauauguaugugcauaaggaagagauacugaggaguaacauuuuaaaguauuugaggguuaauauuacaguaacauuuagagaugugccuucuuugauuaguaaugaugcaaauaucaguuccuuagaggguaaggauuaucuaacuguaaggcuagguacuucuuccuaaggacaugaucaauguaguugacagauguuguauuuguaaauuuaccaaacuuuucuucugcauuuugcagacauguuagucaggaugauuuaauccauggguacugcuaauauuauaauccauaauuauacuuucuuguuacugucuccauuggaauucuaagauacuaagcuuuugguauccacaacuuaaaaguugguuguaaacaaucucguuuugugaaacucagcauuucuguuuuaaaaacgaaagaaaucaacucaaacuaguaugcuugauagugguagugaagauauuagaucauuuuggaaaggagaauggacaccaugcccauuugaagagguaaugcauuuuaaaaucaucuuagggacuuuuuucaugguaagauugcuuaguacagugagucaaguuuauagaggcagaaaauacucaaaacuacuauagagacauuauaagaaugcauuuuuauuaaaaauauaacuaauuuuucaugagcuuaagccuuuuaaaaaaaagagaaauguuuaggacaggccuggcagugcuugcguuuuaaucucagcacuuggaggcagaggcagguggaucucuaggaguaggaaacuagucugguguacacagggaguuucaagccagccagugcuauacagugagacccugacucaugacaacagcaaaaaagguauggagaagaggaguuugguagaauguuacuuucuggguagagguguuuuacauggcugagaagauggcucauuggguaagaauccuugcucuucaagcaugaggauuggaauugaaguccccagcauccauguuaaaaaaaaaaaaugaggcauggcugcaugugcguuggaauuagggugauaacagacagauccaagagcucacagcccaccuagccuggccaaaacagcaagcuuuauuucagugagaaaccaugucucaggccaguaaagcaaagagcaauggagaaagguaacagauacuuccaaucuuacgugcauacaucccgcacacauacacacaggcagggcaggaggcaauugaacuuuuaacccaagaaagaagacuauauggauuuuuuuaauuuuuaagaaaaaacacaacuucuucacucuccccaaauuuagaaaugcuugaaguuauauucuuuuuuuguaucucacaaaaaugagugccuccuuuguagcuuaccaccuuuggauauuguaguuuacacauuaauuuaguuaagucaucuuauguugauugcuaauucauuauaugaaguacuuuuauauuuuguccaaaauucuugguacuuuauucuaacuggaucccggugcaguugacuuggaaugucuacucuguccccugccuagcuuuguugucagucuacuuuauuagaaauuccaugguuguaggacugaaggaauaccacccacuccucgcuucucuccaucccacagucucccucagagugacccaaacuguuagacuccaugguuuuagccccaagcuaaucuuauuuuaaauuuggaagaucaaauuauaauuucuggucuuauaagagacaaauuucucauuacaguagcaguaugacuuuaacucuguaaauauuuaacuuugauuaaugaaugaucaauuaaauauacaagaaaacucuuuaacaaguccuuaaauggaaacuuuuuauucuuuuguuuuuuauacuuuucuuaaaugcaaagcaaaguuaaauuuucccuguuaagaugccaagcuaagagccuccuagccuuuugaagagcaguuguccauuauauaaucugcagacuagcaagagucccucagaagcaggacauuguuuagauuggaaguaguucugucuuguguguaaaacaaugauguggugugagcauuuauuuacagugacagccuugguuucacuuaaguggcaaaacccuuuugaguggcucacguuucauucaccuuacagacuucaucuucccuacagcaaaagcugugauaaugucuagagaccacgugacacagccaggagcauaggccuuuuauuuugucccagacauuugacaguguaaacauacauaaaauacauauuaaaguuuagaugcucuuuauaguuugugcaauaaguugaagccuuaaaaagaaaacauuucauuaaaaaaaaaagucauuaguuuuacuuaagacaggaaaauagcagcaaguaccaagacauugugcacuucuuuuaauuaagacaaauuacuucauuuacaucaaagucagaaauauaagacuggcuuucuugaauacauaauauagcuugaaucacugguuagauaggggcacguuuucccaacuguacaucauggaggaagguucuccuucguuucagaaacugcagacccucagccugccagcaugaccacagcauugagcauuaaaaggagcgaggcauuuacuuuccaagcacuagccgcagaagguggccgaguguuuccauuugcagugguuucuucccuccguaaguugaggguugugcuuugucgaggcauuucagagaaguuauuuggcaugccacgagcuaugcugagggucacggggcuugggggugacuuuguugcacuggugaggcuugcauuugaacucauuccauccuggaggugaauaguuagaguugcagcugcugcuucaugggaauuggucauuucugugggugugucuucuggguaggccaccacagcccuaucagugcuacuaaaagugguaucuuugcuuagagugacaccaaaugugguuuccuuuccucgauauuguuuggguguuuuggucacuuuggguugaguuaccauacucaaagaguuaaugguguccacugucugcaucucacucauaguaaauaagcuugagguaaacccaggaggugugggguacaugcucuguuccuuuagagaggauacuugcuuagaacaaggagucccuaucacaugggcuuucguuuccaucacccacuucaauaaguaaguaauguuuuguuuauggucacaugaccaccuguuauuaugaagaguuaucucuugcaacugcaaaaguuggucaaaagacuguucuggaaugaaugugaauuuauuguugugcagguaaagaugugugagauuugucagguuuauuaaugucccuggaaggauuugugucagugaguuauuagacagguccacgauaugcaguuuggaaggcauguugguuggaacuguccaaagcuuguuacugcugagguuaagaaccucgagacuucuuaggguauuuuuaaugagaacaaccuuuuccagcauauucuuagaaacauccagguauuuaagguuccacugauaagcaguaucagauuugucaagaaguuuaauauuguuguuagcagcagacauguuccagagagaccgagguaacugagcaggcagacuuucaagccuguuguuugaaauauccaggguucucagauugguauaugggguuaacugguuaugcagaucaguaaagugguuauaagacagguuuaaauguauaauguucuccugcaguccaggugguaauguagucaaguuucugccugaacaguccacaugccugugccucucugugcauguacacuggagaggacaaaugcauaagaugccaggcgugagaaacagaaggaugaacaggcaggaagacauuuucaguaucugauauuccaucaaagccugaaaacaaacagauacauccuucuuuuaauaugcaaauucacucucagcaucugcaugggucaguuagcauucggcaaaauuuucaauaaaccuccuuguuguugaguccuuuuauaauuguuccagugauuaaacuaacaaagcugcccuucauuuauaguccaaaugccuaauccuucaauuggggcuauguggugggugggggugggggaacugggggggagagagacagacagacagaaaggcagagagagagagagagagagagagagagagagagagagagagagagagacucuccuacauuuucucuuuauuuuuauccuuuaguauauucaucuuauuuaucuucucggagccuuuauaugauagaauggcacugucugcaaaugaggaguuuuauaggcuuacuuaggcuguuacuauuuuugauaauguuuuugauucagaaaaaaaauggcugucaugucuguuuuucuuaaaucucugcaguauuauaagacacaauauguuuguaguuugagauguuaaaacagauuaaaacaguuuuugaaauuucaucuucucauggauaacuauauccugguaaaaaacguuuuaaugaacuuggaaaaaucaagcccgauagcguacauuuguaaaaugauuuuuucccuuauauuucaguaccaauuuuaaaggaaaaacaauauauguauuuacaaagugaguggacauuaaaaugaaaaccucggcuauuacugcagcagauuuuggugcaugcacuuguuauugaauauauucaauccuaacauuagcuuuaaaaaaaaaaaaagcuaaagaaaaggaaaaaauucaaaauccgucuuuuaccaauuuaaacaacugcuuaccauaaugucgucuucacuaucaguaucucauuuucuccgggaaacuugcagcuuaaaggucgucuuguugugggagucggaaggguuucuggcugugggcucugcuugccagcucagcugcauuguguugcugugagccgaagcucugcaaccaccugaucagcaccacauaggaggacugcagagcugucauuggugcugacucaaauuuauugcaagaggugcauacgcaacaaaauggacuuuuuuuuuucuuuuucuuuuucuuuuuuuuuuuuuuuuuuuuuaauuuacagcccagagagugccuuacauagcuucaguucucugucggguagaauacuucaugcaaauuagggcugggcuuuacuucuguguauuucucugaguuuagguugcacauuuaacauuugcuugcuguaauuuuucuuaaagccucuacauucuuucuauguguugaaaaauguucuuugugaauugauuuccaggauauucauugaacuauuuuuaaucuccgcauuuuuauguucuuuucaaaaacaguuaaauugucucguaaccuuuucauauguaugucaugauagaaaucuugauuuuuaugucuuccuccaucguggcuacuauuauuauauuuaauuagcuuuucgaauuuaucagucaauuacguguuucaucuuaccuuuuaggaagcacaggaauacucaauaugauuacuuuguuuuugccuuccugauacaaaagaucguuugacuaaugcugcacacaggccagcugcguugucgucacagucuccuuccccagcacaugcacacaguccugccuuagugacagugaucaaauaagaacaagccacauguaaaauaaggaugcuggacuauaaaacaacaccagccuaaaauacguuucacugugucuuccuggcuggccuggaacucacagagaucuuccuacuucuguuucucacugcuagaauuaaagaugugcacuaccauaaccaguagauacuagauauuuuguuuuguuucuucuauuuuaauguucuacuuuuaauuaccagucaaaugguaaaauaauuguuuacauuuuauguauuugaguuagauggaguuguuugguuuugauuuugcuauuuuuuuucuuccaugaaacuuguuuuggaugguauggauagaguauugcuuucuccagagguauuguugggucugaacaaaagauaauuuuauuuuuaugaauagcaguaucaaagcuggaguggcaacacacaccuuuaauccuagcauucagcagguggaaguaagaaggccaggaauugaagcccagcuuugacuacacagcaagcucaaggccagccuagaauagaugagacccugucugaaaauauaaaauaaaaugcuggccauggcggugcucagcuuuagucccagcacucaggugacagaagcagggaaaucucuacacauccgaggccagccuggucuacagcgaguccaagacagccagggcuacauggagaaaugcuaccucaaaaaaccaaaauaaacaaaauaaauaaaaacuauuacuuuccaauuguuuauuuaguguuucauauuuauauguuaucuuucccagaaagucaauagacuuaaaaauauauguaacaauguuuguaaaagaugaaacuauaaucaaaauuuuuguaaaauaugacuagauucaugguauuuuaaguaaacuagauaaauaaucacuugaaacucaaaccuauauuacaaaaugaccacuuaucauaggaaagaaaaggagaaaauuaagacauacuuauuaugaaauugucaccauauaaaaaccagcaauuauuaguauauuacauuuuaaguaauaccuuguauugucuccugcuaaaucucaugggcuguaguuuuauuuguaucuaaaaaggaauugauggaauugaaaucuauagcuuaucuucuuagaacagaacuaucuuguaggagucaccuucuagguaaaacuaguguuccucaaaaaggaccuacauuuaagcagucugcaccauuagugacugcuauugguucagggcuuuauuaccgcuuuacguugaguguucauuuggacuuuagauucuguguauggguuucagaauuucaucaucaaucaugaucccugaaaauaauguuugaaguacuacguucaauuuguuuugggggugagaaugguuugcuuuugacaguuagcauuucaugucagcucauguauccaccaauacagauaggacuaaggaucaauuugccaagccuuaaaaucucucuuaggaagacucauucuaccauuauagaaguggaauuaccuaugugaauuacacugauaaguaccgucauuugaaagaaaaaaauaauuaguuaauuguuucaaaauuaauucaagcuuagucuguaucagagacuuuuugcuagcacuguaacaaaaucucugacagaagcaacugcagaaagaggaguugcucauggcagggaagacaugggcacuggaguagcuuggucgcuggcacaggaucaggucauauccagugguaaaugagaagcaaaaccaaguucuaauggucagagcucacccccaguggccuuaaggccaucagcucuugcucuaaggguuuaauaaccuccccucagcacuguccacacacauuaggaucggauucugcuaugcauauaauguuuuucauuucaaauuuauuuuguacuaaagaugaccauggguacucaaaaagaaaaagagguugucauuucaguguauuucaaauguagcaauuguaaugcuguuaaaggcucugagaaaauuaaauacuauauuaugcuuuuuugguuguuuuguuuuugagacauguccuauagaccaggcuagccucaacuuugccucccaagugcugggacuaaagaaucauuuguaaaagacaaguauuuguuaccacuuaucuuagaugcuauacagaagcauuaauuauaauuuagauagguucaccaacuucacaaauuauaucuauuuaggcaacugguuuagauuaagcauuaaucaaguugacauuucuuuuguauccaaggauauauugcucuagcauugugacacagcaaaccuccugcuguaguaguaacuauagacauguguguauguacauguaucuguccaagcuuggaaguuguuguacaauaguccauuagcaggaaaugcuucugucucaagcaguuuggaaaggggggaugcucaaggguagaggggcggcucagugugcagcugucaaugcagccuaaguuaugcgcuuauauaccugcauaguagguaguaaccacuccaguggaccuucauucuuuuuuuuuaaucaauuuacuuuuuaaaaagauuuauuuauuuaauguauaugaguacacaguagcuguacagaugguugugagcuaucaugugguugcugggaauugaacucacgacuucugcucacuccagccccacucucucuggcccaaagauuuauuuauuauuauauguaaguacauuguagcugucuuuagacacaccagaagagggcuucagaucucauuacugaugguugugagccaccaugugguugcugggauuugaacugaggaccuuccgaagagcagucagugcucuucccugcugagucaucucaccagcccucaauuuauuuuuuuuuuaauauuuuuauuagauauuuucuuuauuugcauuucaaauguuaccucuuuccuaguuuccccucugaaaaucaccuauucccucuccccacccccuucccccugcuccccaacccacccacucccauuccugguccuggcauuccccuauacuagggcauagaacaggaccuagggccucuucucccauugaugaccgacuaggccauucucugcuacaucuacagcuagagccacaaguuccaccauguguuuucuuugauuggugguuuaguuccaaggagcucuggggguacugguuaguucauauugauguuccuccuauggggcuucagaccccuuuagcuccuuggguacuuucucuagcuccuucauuggggaccuugugcuccauccaauggaugauugugagcauccacuucuguauuugccagucacuggcagagccccucaggagacagcuauauuaggcuccugucagcagucucuuguuggcaucugccauaguaucugugaguuuggugguuguuuaugggguggauccccaaguggggcagucucuggauggucauuccuucagucucugcucugaacuuugucucuguaacuccuuccauggguauuuuguuccuccuucuaagaaaguuucugagcuucugggcuaauauccacuuaucagugaguguauaucauguguguucuuuugugauuguguuaccucacaauccuccagaucuauacauuugucuaugaauuucauaaauuaauuguuuuuaauagcugaguaguaaucuguuguguaaauauaccacauuuucuguauccauuccucuguugaaggauaucuagguucuuuccagcuucuggcuauuauaaauaaggcugcuaugaacauaguggagcacauguccuuauuacauguuagagcaucuucuggguauaugcccaggagugauauugcuggaucuuccgguagaauuauguccaauuuucugaggaaccgcuaaacugauuuccagagugguuguaccagcuugcaguuccaccagcaauggaagaguguuccucuuucuccacguccucaccagcaucugcugucaccugaguuuuugaucuuagccauucugacuggugugccguggaaucuuaggguuguuuugauuugcauuucccugaugauuaaggauguugaacauuuuuuuaggugcuucucagccauuugguauuccucaguugagaaaucuuuguuuaucucugacccuuauuuuuuuuuuaauaggguuguuuaguuuucuggaguccaacuucuauaaguuucagugucucugguuuuauguggaguucuuugauccacuuagacuugagcuuuguacaaagagauaagaauggaucaguuugcauucuucuacaugauaaccuccaguugagccagcaccuuuuguugaagaugcuaucuucuuuccacuggauggauuuagcuccuuugucaaagagcaagugaccauagguguguggguucauuucugggucuucaauucuguuccauugaccuaccugucugucacuguaccaguaccaugcaguuuacuuuuuacaaaaauaauucauuuauuuuuuauuucuuaugcauugauguuuucuuugcauguaugucugcaugaaguuguaagauucucugaaacuggaauuacaggcaguugugaucugccaugugcuugcugagaauugaacccugguccucuggaagagcagccagugcucuuaacugcugagccaucucuucaaccaccuuuauucuugaauugaucaaacugauuguuccuguaauuaauugugagccaaaguacugauauugauacaaguucuguaucccuauuuuuaaguuuuauuuguuuuauuauuguauugcgugaaugccuuaccugcauguauuucugugcaauacaugugugacuauugcuagcuaaggucagaagauggcauuacaucaccugggacucuauauacaaaagguugugagaugucuugugggcacugggagucaaaccuaggaacucaggucuccuggaagagaaauaaaagaaaauuuucucaaccacugagccaucuuuccacccucagcaucccuuuucuaaaaugccugaaaccagaauuauuuccaagcuuggaauuauuaagauacguuuacagauacguauacauacaugucuauugagaguauucuuugggugaucucaacucccccaaauuuuugagcacucagaagauuguagauuuuagauuaggauuguauagucuuuaacacaguuaccuuuuuacugaauuuccugcugacaacaacagaauaauaguaugaacuaaaguguuguugaagcauagaagaacugacaaaacagaacuguaucaacauucaagucauuuuaccaucuuuaacaaaaaaauuuuuuuuacuuuauucucaacuuucgccuuuccauguuuuaaaucuuuuauuuauuuauuuauuuauuuauuuauuuuaaacuccagauuuuauuucccucccaguccauccuccaacuguuccacauccuauacuuccuccauacccccacccccaucuccacgaggauguccccacccucaccccaccauaccucuaaacucccuggggccuccagucucuugaggguuaggugcaucuucucugacuaaacccaaagcaagcaguccucugcuguauguguguugggagccucagaucagcggguguaugcugccugguugguggcucagugucugagagagcucagggauccagguuaauugagacugcugguccuccaaaugaguugccuccuccucagcucuucaagcuuaccccuaauucaaccacaggggucagcagcuucuguucacugguuuggggcaaaaaucugcaucugacuuuuucagcugcuuguugggucuuucagaggucagucaugauaggucccuuuuuaugagcauuccauagccucaguaauagugucaggggaggucuuagggccuccccuugaguuggaucccacuuugggccugucacuggaccuccuuuuccucagguuccccuccauuuccauuccugcaguucuuucagacaggaacaauuaugggucagaguuuugacugugcgauggcaaccccauuccccauucuucacuggaugcccugucuuucugcuggaagugggcucuacaaguucccucuucccaauguagggcauuucaucuaaggucccucucuuugaguccugagagucucucaccucccaggucucugguacguucugaagaauccccuccccccaaccuccuaucuucugagguugccuguuuccauucuuucugcuggcccucaggauuuaaguccuuuucccccacccaauaccagaucauguuccccuccccaccaccccuuuucucucucaggccccucccucccccuuugugguugcuuucuucucccucccaagugggacugaggcauccucacuuggguccuucagcuuguugaccuuuuugaauuccuuggacuguaucuuggguaugcuguacuuaaauacuugcugcuauuauuauuauuauuauuauuauuauuauuauuauuauuauuuggauaauauacauuuauuagugaaugcauaccaugcauguccuuuuggaucugaguuaucucacucaggaugauaauugguuccucagaaaauuggaaauagaucuaccuaaaaacccagcaaucccacucuugggaauauacccaaaagaugccccaccaugccacaggggcacauguuccacuauguucauagcagccuuguuugugaucgccagaaccuagaaacaacccugaugacccaugacagaaaaaugaauacagaaaaugugguucauuugcacaauggaauacuacucagcuauuaagaaugaguuuugcaggcaaauggauggaacuagaaaaugccuuucauuuuuaaaaacugugugugugucugugucugucugucuguguaaugugagugccaugauguacauguggaggugagagaacaucuuggaaaucaguuuucuccuugcaccauguauaugggucccuggaaucaaacuugucuuccaguuugacagcgagugcuuuuacccccugagccagugaguccccuucagccucucuagaguguuccugacuuaucuacuugcuuucugggaauguuugacauuguuauuauaucccugguuuucccauaguguuccuaacaacauugaccuaacugcuuauuugucuuauggaagagcaggcugaaaaggacagucacaugaaugcagcaagaugacagaccugucaugguucuggaguaucuuucauugaggagggacagucaguuuuguacccagaauuauuugaagucauucuuuucuguuugucauaaacauggcguaauguuaaauuaauuuucuucagcuacuuuuccguuuuuauggcugauuagucagaauacuguaacuguguauauagaggacuugugcuacucugguuugaccccuccagucuuuuuuuuuuuuuuuuuuuuuuuugcuccuauugguguggagaagaacugcuuucaauucauuugcuugcaguuacaucuuaauucuuuaaaaaaaaaaaagauuaaaauauguauguguauauuauauguuuuugucuucucauguaaaaguuugugugaugaauuguucuauaucguauucuguuuuucuuauuaguucauuuuaaagauaacucuauuuaaagagacguggguuugucucauucauuucuuguugccuuggggaauauaccuuaguuguuuuggucugacuuguccccauacuuccauuauugccaauaaugacaugcucugauccucgugcuugaagaguuucauauuuugccaguaacuuuuuuaaaacuucuuuuugucuuuuugagauaggguuuuucuauguaguccuggaugcccuggaacucacucuguagaucaggcuagccucagagacucaccugucucuggcucugagugcugugauuagagguguaugccaccauuucuggccuuuauguauauuuucaagaauaauccauguauauuuuuucuucucuggauguguuuauguuuuauaaaauucuguuguuuuauuuuuacuguccacuauccauuucuguuauccaucuuuaagaacuuucuuaacauuuauagguauuaguacuuugucuuuauuuaaaauaucucaauugucuuguguuugucuuuugacuuuuuaauacugaguuauauuuugguuuugacauuugaaaauuuucucuuuuguuuuuguugcuucuagacuuugagccucagcuaggaagauguuugcccauguuuggauuauaaagggguucagcagcaucuucuuguauuguguccacucuaugcuauuuauaucuugucuacuuaaugucuauucuaaaugugaaauguggauccaauuuucauuuuuccaaauauccauucaguugucucuccagcuccuccauuggcuacuguccugucuaggagguauuucucaauacccauuuuuucaagaggucaguaagugaggugcugaaaggaacaacuuuggaaagagccuuuuaguuccacaagugauaugagaggaguuggaugauuggcauucaagcugcuacaucuaauuacucuaauacuuaaauacaagaaauucucaaaauuccucagugacugcugcaauguaaauuagccuuaaaaucauauuugaagacacgugagaaauuuuauugugaaugacagaaaagaaccaauguaauaaaaugaaacgccaucaugcuugaaguagguguuucuguagauaaaaaaaguguuaucaguaagagguggcuuguaagaaguaagguaaguauuguauguaaaauaacacuuaagcccagugucuuuuaagguguuuaaaggucacaccguuaaucacaaagauugggagacagaggcagguguaucugugaguuugaggacagugggucuauagagagagagugccaggacagccagggcuaccagaggacuccugucucagaacacaaacaacaacaauaauaaauuuacauguauuuauaauauguauaauaauuguuuauugauaauuauauacuaaauaauaguaguaguauguaguaguaauaguagcaguaguaguaaaacuccacugcccgagaaccuucuuguuuuuauucuacaugggauuuuuaguauuugaacauuaauguuaccaauaaauacuauauacuaucuugaaaagugccaaaaucugugcucuaagcaacuguccuuucuuggacuuguaauaauaauaagagaaggauggcuuguugggcagaugaacauuugacaucugcaaaagguaggccaguacccacugccgccuccacuuuaacaaaaguugugcccacuucuguucugagugccucauacucaacaaccuucaggugaugauuacauuccugcauuuacaaaaggaggcuggggcugcagugaugggucaguacuuuagagaacuugcugcuguccuauaggacccaaguucaguucccaguacccguguuagacagcagcucauaacuuccugggacuucaguuccaggauggcugguauccucuguggucuccacagacacccucacacaggcugguaucaugcaugugugggaagagacacacagauacagcccacuucuauuuuuuucucccgucuuccauaucauuugauuuuugucuaagugguuaguuuaugcuucccuaacauuuuagaaaaauguuuacauuuugggggcagugagaugggcuuagaggauaaagguugcuugcugucaggucucaugacuugaguucugaauuuuauccuugagguggaagaaaaaaaucaacucccacaagucaucuucuaaccccaaauacagccuaucucuuugaccuccacccccacgccccaaacauuugaagaggaagaggaggaggaagaggaggaggaggaagaggaggggaagaacggaguugcaggggcucggugguuaagagcacuuacagaggacuuggagucaguuccaggacucacggggcauuggcaaauguuaguagugccaucuucugucuuauauauaugugugugugugugacuauaugaauauauacacacauauucaggcaaaacucuuauauacauaaaauuuuuaauuauaaagaaaaaagaaaauuuuaugguaagugcucacuuuuucaggguaaauguaucccaaacacagcacucagacuucauguuuuaauacaguuugguagcuguguguuuaaucucuauaaaugaaaauauuuacuuaauauuugaaguauuaaaacuuugaccauuuaaaaauuuccauuuuuauuauaccccaaauuuugagguggaaaaaauagaauuuuauuuauuuaagauauguuuauauacagcuuuucgggggaaaucuauuggguaauaauaaguauauguagaucauauguuuccaaagugauuaaguuauugaaauaucuaucauuaacauauauaaaaggcacucugauuuaaaaauuacuucuguagcugguaagcauaccacuguaauaaucuacccguguacgugggcuucagucaggggucagguagucccuaaagagucucucaggugccaggugucauguccugugugccauaccacgaagacaggaacgugucggugccaucucaggauggagggcagucuagaaagccagcugucacuuuacagcagcucuguagguggagguggcagggagucugugaggucuggauggaggucaggaguagagaacuccuggcauugagccucgugggccgacucuugauuguuuauaaaaucuccugcugacagaggcacauuaaaugagucaggggguggcgggaauggcucuuggaucuuggaaugcuguucuucacacacuugauuuagaccaucuggagaugguuggggauugauagaaucauuugguaaaggagauacaacugucacugugggcuuguuugguagguucucauccaaaucaagaaggggagguggcagggccagaucugcaucaucugaagacacggcuguaccaacuguugacccaucagcacugucuucugauaagccauuuauuugaacuucuacauuaucagucuugagguugcugguaucauuaauguguucacuugauucaaacaacuuaacuucuaaaucaucugcuagcagugugcuuuuacuugguuuccaggucauaagugagacaacugaugcacgcuuuguggaugccucacucucucugauguuauccauacacauuucugguguuucuccaucagcaaauggagaccuaccugcccaguuuugaucauuuaagacuggcuuccucaaguauuuccacaguauaaucaugaguauagcuaccaacauagaaauuauaauaguaccgauuaauauggcagcaauugcauugugguuguuuuuaugagcaguuccuuugccacuuggugguucugaagugaguggugguggugguggugguggugugucccuuuguaaauaaauaguugguguugauuuugugggcugauuaugaguagacucuacuucugguuuuccagaagagguaggagcaggugaugguggcuguuguguggaaguauagacaagauguuuuggugguuguccaguagaauuauagguagaaggugauggcugauuggucaaagugaacccagauggugauguuugaggcaaggaguuguugaccgcugauucugcuugucugguaauguuauaaguaagugggcuugaagagacauaaacagcugguguugcuuguucaggagugauuugggcaggugaugcuugcuguccagaagaaauguucuugaaucuuguugucugacucaaagcauucccugcuguguuuugagaaucaguuguaacauauaacgacggugugauuaaaguagacagugauugcugcucuguuguaauugcuucugucucugagaaaaacguauuguccagguauugacaaagcacaaugaagaccagauacuugaauuccauuucagauguuuucuccuuaccagugauuucacaaugaaagaaaaagaaauaugguuagcuaucaccuggcgucuaguuacauuggacucuucauuacagugucugacauacagugauuaggcauuugguuaaauuucauucuaguuucuacuugacacaaugugaugcuccgguuuauaguauagcaucuggaguuccugagaaguaaucuuaauucuuuuauaaaaucuguuuaaccuugcagccccucuagguuccucagcuucuacuccuucauuucauauugucuugagugugcaggcucaaccugaugccuguucgcugucuguucccagaaauaaaguggucugccuugcagagagagcacuggugaccacagugccuuacacuauugccuuuauguucuuucucucucucucucuccucaccaaauuugaccuuaccgacuagucccucgccaguauuucaguaacccuuguauuacaguuuuuccuuugcaccacuucaguuagaucuuuuuugcuccugucuccuaaauauagacacucagcauccaaucucucucuaccuuucauuuuucuuuguucuaguucuguaaguguccacucucacccuucugcuauaacuaccaaaccugugcaaccugaaccuccuuuguucugaguccauuuguaucaugucuuagugggcauguuuuauauauauauauauauauauacacauauauauauauauacacacacacacauauauauacauauauauauguauguauauauauauauauauauuucauaaucagcaaauucaguagaucuagucccaaggggaccucacaccucuggucuguauggcaucacacucguguacacacacucacacaugaacacauacacagaaugaaaguuaaaaauacaaucuaaaagaaaaaacaaaaaccaagaaaauccuaaagugauucaagucucucuagcccaguuggucaaauaagcaagcccauuacugcucucauucugauacuggacaaccaccuuugcacaucagacccuagucuagauuugauaaauuuaaaaaaauuaaguugcuuucaaguguuuuaaacucuuacgguaaaaauuagcagguaaaaaguaaucucagccagguguggugguucacaccuuuaaucccagcagaggcaaguaaucucugugaguuugaagcgagccugguaugcauagggaguuccaguacagccagggcaacaaagagaaacccugucuugaaaauaauuugauguuuccucauacuuaguagaugaacagaggaguuaacuuggcaagggggaacuuuggaaagguuuuccagagauauugaagcagauuuaaaucuuagaauacuauaaagagcuaguuaaacacaucugucucccagcuuagacagugugcacgggcaccugggcaaggcucagcauaggcuugacagcuaucuuucugcgggaugucauagauggugaaacuuugaaggcuuaaguuccgaaguuccggcugauacuguccacuuaacucagugugugaggucaccuauguguguuguuuucaguagccucacgcucuaaagugacauugucagugcugaggauaaugggcucuucuggacauccccaagcauagugucucucucugagagagcugagcugucucuuaacgugaaggagggacaagcucagacuguuagauacuaguuucuguguaugauaagaaauucauuuuuccaggacucugaagaugcaauagaagguuuugacaguuugaguaguuuguauuucuuuacccaguuaccacuagcauaguagaaugaugaugacaaaugacacccuucuuguucauucucucucuuguuuguuuguuuguuuguuuguuuuauguuuuaagacacucgcccaguuuagcccagguuggccuugcuaagauccaugauugcugagaucacaugcuugagccagaggaccuagacuuacaagaaaagauaauguuuuuuucuagucuguuucuucuuuauauuuucucucucaugcuugaagccuaaacuguaaaauagcucucugaagccccuugccuggugcagguuaguuacccuugaaccaugcaugaccugguugcuacuucacacaaggauacacaucucugucuggagaaaaccuuacaaaccaagcuuuagcuuccuugaauacuuccuaaacacauuaaauuaugccauuuugcugccuuuaguguuuucuuuuuuucccuaauccuuuuuucugcugacuauaugucugaaccugucuucaucuuguagaccucaauuuaaauuccccuucauaaacccaguucucugacugaccacaggcacagauagcuuccccugggcauccucggccugcuguccugcugguuucuuuggcccuacuuuguggaugugccucauuccugcuucuucccaccugaaugguuguuuuuauuauguuguuugcacauuuucuauuauuauccccauugccuuaaacgagauuauuuuaaaaaacaauuccacaaagguaggaaaaaacaaaggaagaaaauaccucuauagaguaugcuauaaaugggcuagagagauggcucagccguuaaaggguaggcucacaaccaaaaauauaagaguauucgauaaauuugagacuuacauacuuauuucauuuaaccuucacagaagcaaauuaaaaugaguugagcagcuugucuggguuguggcuguuagugacagcaugagguuguaccaugugauucuaaagucugauuugugucuguucucccuccguuucagguuuucuaacgucgauucuccaugccuuucauuuuaguugcucaguaaauauuuaaucugcgcuggccucuugguucuuuacugucucacuuugacuuucuguuaagccuucuaccauaauacaaagaaaacuuaguuaaauucuguguuuuauccaucuuuuaagguuuuuuuagggaaacauugaaauuuuuggcguggauaugagggucugacucaucucuagauggucaucauuccuaucguuccacacaguaauuuuauagguuacuuacccaaaaagcuuugguuagaaaaugguguucaaaguuuucuuuuguaaauguuuuuagaaaaugcuuuccaaagcaacagaagauauagaauugucuccaacuaaaaauguuuccucuuuugugacuuugcuuaaaauaaagaaaccauaugguuccucuuuuuaguuagcugaaaaaggaaacagagaaggaaccagcuaacacaggaaccgaauuauaaaacccagugugguuuguaagaucagcuuugauugguucaucaccucugaugucaguaggaagcuagaggcuucagggugaugcuuccacuugucagcaguaguaaaagcaaaacccacuuuuaaaauagcauccaacauuccccugcucaucauuucugucauguacccuccuaggaucugccacaggagaguacuagaaccucuuagaaucucacucuagcagcucugcauacucuagagaagcaucaagacaaaaagaagacauuuuggauuuaauaauuuugggggacaggaagccugacucuuuucagauuuaaugaagcuguuucuguuacuguaacaugcaagcuuauucaacauacuugccaacuuuguaacuuguacauuccuaaauggacacuguuucugcagagaaagaugauggucagcugauuuggggcaggggauaaaaaggggauuaaaauuuagaauagaaagaaugggaauaaguauuuuuuuucuuuuauaaaaaggagcacuaacaagaaauuauaaaaaaaaaagguuuaggaugcacuagauaugugggaaaggaucaguugauuagaaaagauauugaagaaaaagaaauaauuggaaaugguaguugcuuauuaacuaucaggaaguuacuaaagaagacugaaguaggucaaaugcaguuagagaugggggugggggugcuggggacuuagcucagugguagagcucuugcucuugagagagaaaaugaaugaauggacauagguaaagaggauuguugagaauugucauuuccugucauuggccuguaugugggaacaagaauuaacaaagagcugaccauccaggacagaggcuacaugaccaguccucaauccaggcuccauucagcuuccccuacccucacugcccugccacaacccagagguaacccugacaaccacagagaccuaggaacagucuauguaggaccuuucuuagaaagccuuuacucuccugcucagggaaagcuagauuucucaaccuuauuauagcaauacuucucucuauuuaaauucugagguuuaaaucugcauuuugguucuuuguuuuuuuuuuuguuuguuuguuuguuuuuguuuuuuguuuuuuuaaagggaaaauguacauauuuuuagugacuucguaugcaccgagacaaugagaucggaacucaugguggccugucgcauacugccagggcuacagugauugccugccaugcacauggcccugaguuugguccccauuaccacaaaauuaccuaagaaaaauuaaugcuguucaauuggcuaucauaagaaauacauaucauuuuaauaaggaauugaugaacuuaggaaaacauuccuuagggaaaaaagguaaguguagauaguuaugucagaguuugucuuugaacugugcauggugucuuaggccuuuaauuccagcacuggaaguagagguaaauggaucucugugaauuugaggccagccuggucuacuuaaggaggcccaaaccagccaaggcuagauagugauaaccugucucaaauaaacaaacaaaauuagaucuuucaguuauuuugauauaagaaaaauaaguauagcuggguguggaagcuuauaccuccauuucuggaggcagaggcagggaggucuuagaguuagaggccaaccaggucugcuuguggguuccaggcuaaccaagguuauauuguagggagacccuguccccaaaaaccaaaaucaaaagcaacaaguaaauuauaguacacauauaagagguaggcacauaguacuagugcugucucuaaacuagugagauuuuaaaaccauaguaggaagaaaccagaaaaggaaaucaaucucaaauuacaaguaguauuuuauggccauuuuuuaucaguaaaaauagcuaccauugcugaacaccagaaaauuccugaguaauaagauuuauuugcaugaccuaggugguuguauuuucaucuuccaaguuuuaaaaaaaaaagaaagagagagagagagaacuugguuaacuugacaagcugucacagcccuagugguggcacaguaugaaaccaugcugcccugagccuuggacuucugcuacaugcuggagccuuuguagaauuaugaacaagaaaggcagaggagaggcagagaggcagaggccuaggcagagccaggcagaucucucugugaguucaaggccagccugauuacagaguuccaggacuuuaauuaauuaauuaaaccaggaugcuauaaagaaaaguuauguugauaaaguguuaaaauaggaccuaacccacuuccaaauuauuuuucuuugggauugcaggucuuuggaagcucagugcauuuuuauuuauuuuauguaauuguuccauuuagucacaaggcaaguaucuuuuguauauaccaacaaguuuuuacaaaacguucuuucugugaauguuucuuucuguucauauucuucacuaacaggucagcucagaguauguggcauaagcacacaugugaauaugcacauacccacuuuaucauaauauuuuuuccuuauggaacuuuuaccuuauuuuuuuuuuuuuuuuuugguuuuuucgagacaggguuuuucuguauagcucugacuguccuggaacucacuuuguagaccaggcuggccucgaacucagaaauccaccugccucugccuccugagugcugggauuaaaggcaugcgccaccauguccggccuuauggaacuuuuaaaaugacauaauauaugucauaauuauuacuuaaauauaaaauuuauuuuauacaaaaaugacaucuaauuuaauuucucuuuaaguuaaaacgaaggugaccauugaugguuuauaaacuaaaguguuagacaaaaauaauuuaugccaguaaugguagugaaugcuuuuaauccuaguaacuuguguguuggagacagaaagaucugaguuagaagccggccugggcugcauguaaaagcacugacuuuuuuuuuuuuuuucuuucuaaauaguggggaaaauacugaugagauaaucuaaaucuauaggaauagacagucuguguagaaaguaacuuagacucuguccccucucuguuuacaaugccaggccaaaccccaggccuuauacauguggggcaggcucugccccagcuugagaauuuuuuaaacaauauuuuagagauuguaaauuuagucaaagccuguagaauuuaauuuuauuuuuaacucuugccuuacuuaaaauuauuaaagugauuuaacaaauauuuugacugaguaaacuucaaagggcugauaauauuaaaaucuugauaaaaaucuuucagacaguaucaacccugaguauaaauuuauaaaauucugcacagcaggaccacagaaacuuucuguagacaucuuuaaacuguugagagcugaauucaacuaaguaugaaacacuaauacuguuuuaguuuuuaaaauaaauaagcaaaacugaaaucagaaaucagagggccuguguccaggugugcuuaccugugaacuucuuucgcagaauguaaauucuuguucuaacaggacauguuggugauuuggcugagagagcaaagggguguuucagugcggauuaacgguggucuccagcgcacugagacggcuucugugcagcagaggaaguuuaucaguagccguuacaggaagugcaauaugccacagaaugacuaagaguuugcuccuucaccagagcguauuuugaaacacaaucuauauaacuuuaagugcuuguagcugauguuuguaacugaucccugacucuccaggcauggggauccauaaucuaaaaauuuaggacggagucuugccugagaaauuaucuauucugagguaaauucugagggauauuucuuauuagaagaaaugaauguuguguaggucucaggcaagucagugccuucucacucaccauuuccuccucuaaaaaccuacuguuuuggaacauugugagcacuggguaagaugacaccucccauggcaggugagccgugcaugugaguguuacuccuucaucgguagcuuaaauugacuccaugaggauaacugaauuauucugugucugccacccaacuucaucuuugauugcagaaaaugggagcaacugucugaagucauuuccaaucaggucuguuuuacccuugaagaagacaagcagagccuggcauaaugaugcaugccuguaaucucagcauuuuagaggcagagcaggaggcucucugguguguuggagaucaucacacacagugacuuugaggccagccugaauuacagaacaaacaaaaccccucacuccacccccagaccuuauaaccacaaaaggacuagggcagagcagccagaagagaugugagagaaagaaagacauucaugaugcucuggagaguaaaagugaaaggggaaagucugcuugcccucugugcuuuaauuuucauuuuaucgacacuuugcuuuaucugguuaugauuuacuaaacauuuagggagaggaacuuuuuuuuaaaacuaguaguaaauucaugagaaaauuuguaucagcaguuaagagcacugacuguucuuccaaacaaccaaguucagcucccagcacccacauggaagcucacaaccaucuguaacuccaguccuagagaggaucuggugcucucuucuugccucugugggcaccagacacauauguagugcauagacacauaugcaagcaaaauacccauacacauuaaaaaagauagaaagaaaauaauuugauuucaugugccucucaacacacaguucauuuaaagauguaacccagaauuugaaguaacagaguugacagagguaaaugugauggucaaggguaacaccaucgggcugcagagauggcucagcaguuaagagcacugacugcucaucagaagguccuggguucaagucccagcaaccacauggagacucacaaccauccauaaugaaaucugacauccucuucuggugcaucuggaaacagcuacaguguacuuauauauaauaaauaaaucuuuuauacgggggaaaaagguaacaucaucuaggaaguuaggaagaaacacccaguacuugacuugaaagucagcucaauauaacuggaaucagguggagggcgugagauuaggcauugauauuuuuauuugguucugauguguagccaggaugaaucacuaauuaagaggaaaauguuaagggcuuagagggauggcuuaauaguuaagggcauuugcugcucuuguagaguacccaagucuaacacccaccuggcaagucacagcugucuguaacucuaguuccaggggaucugacacccuuuucuggcaagggcacugcaugaacauugugcauagacauacauacaggcaaaacacccacauaaaauaaaaauaaauccuuacauuuuuaacaaaggaacauacagggcuggagaaaugacucagagguuaagagcacaaccagaggucuugaguucaauucccagcauaguagcucauaaccaucuguaaugagaucuagugacuucuucuggcacgcaggcauacaugcaggcagaaugcugaauaacagauagguagguaaguagguagguagguagguagauagguagguagguaauuagguagguagguucguagguagauagguagguagguagguagguagauagguagguagguagauagauagauagguagguagauagguagguagguagauuaaaaaaaaaaaagaaaaaaaaaaagaaacauccugcucuugcaaagacccagguucaguucccaggacucacauuaggugguucaacaucaccuguaacuccagcucuagagugauacugaauaaacuagauucugugagcaccuguacucacaaauguauacacacacacacacacuucacuuucuuuuauucaugcugcucuggagaguaaaaguggaaguugaucauuuauaaguuacuuagcauccuuagacucuaaacauuaaccagcuuuaaagcauuuguuauguuuuguuguuaaugcuuaagacagggucucaauguguaggcuaggcuagccucagaaaccucugauuugagcuuccaaaauguugggaauaguauaugcauuuauguuuguauaccauguguaugccuaguucccaaggaagccaagagcccuuggaacuggaguugcagccagcucugaggcuugugugagugcugggaaucgaaccaggguccucuugaagaccagucagugcucuccucucuucugagccaucucuccagucccuuuagauguuauucuugaacacuaaaacauuuuuauauuuauucauagccuucuguugugggagugaaucugaucuauuuugguuguguuguuuuucuuauuuuuauaacauauucuaaaacaacauaaaugaaagauacauagucagcuuuguucuaaagucuguuuucauuuauuguacaaaauuaaguuuuaauguguuauguauaauagaaaagcagucuugucuuacgccauauguaaagguaaaaagauguagccuaauauuagcuguacuaagauagcaacugguacagguucuaucucauccagugagaauguaccauugcguuacauaguugaauucuacacauugggaauuugacaucugcuuggcucuaagggcuuaaaagaacucuuccaaguucaaguacauucagacagaggucauucacugcugaacaggaauguuuaauuaccucauguuauuucuauuaguuucuuuagcugcuguuguuuuacuuucuuaaaaauaugaaguacgaaacagauauaaaccuugagcaagcauacaucucccuuucuggucugacgcuaaacaaagagcaugucagacuuuggaucaucugagcaaacguggaugggaaauaccaccagccagcuuuauuucuaacucugccuuccucauugcugcuuugcauuucccuuuccaacccacagccuaguugaguuuuucaguuccuucuucgugcuuucucucccuggcugcuguaagcacaccaggagauugcaauaggagguuggagccugugagcuccuuugcucuuuuccaaguguccgacucagcaguccagagcccacuacuugccagaaagucaccguugcuccgcggcuggcgcuugccuacuugcuuugaccuuuugagagaugagacuuuguuugccagaaccacaguugauagaaauagaaagguacagauaaggaaaagcacugcaauuacaauuaagcaaauuagcauggccguguugcugguguucuccucacagacuuccuuuuuaaacguuucccccugacuuuugaucucugcuguuggagaacuguuucugaaggcauggggcguggaggacuugaguguagauguggaagcuaaaggcacagggggagaugaugcaggcuugucuguggcgcucaccuugugacccacggcaggagugacaagguuuguguuauugucacucggaugucugcuggagccauucugauuacuggaaccugaggcagugacacugcuagcccacagguguguguaguuuggucuuguuccagaagacgacgaggcccacacuguugucaucaggaaaacaagaugcagguacuguccuuugugcuccauaccuacagguccacugcuaucuguugggacagcaauaucaguuguuaguuuguggaagaacagugucuggcacguggaguaauuguuguuaacaggcugcacuugagauagcacaaggacgccagagauccaugccuaccuuuuguuauuggauucuucucaacugaauuuguuguuuuguuuuuuaacugaauuuucauuucuguucuuagauuguacauaaaaauugaaaacuuuuguuguacauucuguaaugcuguaaguuagcauuacaaaucuauugaccauguuuaaccuugcaccauagcucuacaaauucuccuuuuaagggagugcccuggaccugggcuuggaguccgaugcuucugcuuuugugcugugcuuccucuuugaaggcuccuucucacagaaguaccacccucugacaagcacagccucaucuugaaggaaaggagaacauggccuugaaaguuucguuucaaguuuuaaaagauauaacaaguggcuuuuuuugugggagagggaggguggagguugguggagccugagagcaagugugcaucaaaugagaaugugaagugcguuuguccuuuccagcaugaugcuaagcagcuugaggacucugguccuaggaugcaacucugugaguaccgcugauuccaccucuguugcuguagcuggcuauggcuuuccaauagcagaggcacagugcuucucucaaccagaacccggaaaaacaaaagacuucuuugcucucaagagguauauaaagguggccacccuuauugucaguuuguaacugacaucuuuuucucccuuauuuuaacagaaaucuacaaaagaaauuauagagaaaaauuaaaaggaaucacucaucaggcuccuggggcccaagaacacagugcuugacugugagcagcucaccguagcauuagaaggcugagacagucaggggcagccuugugguugcgcaugcucagcccucgucccaccccuccucccagacauuuaguuuaguuuaaacaaaguuuaguuuggggcucagagcuuccuagaagccagugucaggacaagauucuguucuuagcucuuguuaucagcuaucugcuuagaggucucucugggggugucaugucugccccaagugcagcuaaccuagcaagagacauuuggcuacaccuuuagagaaauaaguuguuucuucucuuuaaaaagucagccuaccucugccuccugaguucugggagcaaagguggguagccaggaccagaugagguguuuauaauacuauaccuguucuccagagucacccuuggaaaaauauuuuauucagagcauaaaugagaggagccugagcaaacucuagacuguucuaagacucaaugaguguaguugucuuguuaagauuguuuuauagcuguuacuuucaaacuugacuauguggaggaguuuuuuuuuucaggucuagguuagggccuaagauucugucucuaaacuacuccuaaguaguacagauaccacccugcuggucacacuugagccagggagguuuacuaugguauaaucucuggcauucgacaauaucgaaaugcuaauaaagcacagaaguugagauuaacaguugagauaugcuaaguugcacagacaaaaauagcauauaguaaaugaugcuaguuagaaacuacaguuugauucauaucuuauacgcagaguggagaggggagcccccagugcucugggguccgaucacuauugagauuaugacuguugguagaugcuuaaagaucaacugcacuggcuuuugugcgauaguauuccgcuucaucuucaaguuggaugguaggauucucacgauacuuuauacgucagucacauaccaaaaaaaaaagcacuuuaaauugauuuaguaagaaguguccguccuuuccuaccagaguagacuuaugcagucaguguuaaaugacuuaauguaggugauuuuaaucacauuaguucauucacagugcuguauacaucacaguguuguacacgcuagccguguaccacaggacaacauaauagaucugcuguugguugucuucagccagaugugcugucaugcccuaguaaacaagcuguuggcaccaucagacucucucuuugcucacaauugccugagaacagaaacuguuccuacaucucuauuuuaugccccagaggccaaguuggcuuagcaaaguuuugauuuucugguuuugguuuugucucauuauuuuuagucagauaggucauuccucagcugcaguaaugagaauguauuuccuuaauuuaaaaacaaaacaacaacaacaacucaaagcuuuucaacucauuugaguacaaacucaagaccuuccucauccugauuuaaauuccauauuaauaauuauaaauuuuuccuagaucuaauugauuaugcuguuuacuuaauuuuucauaguggaauagaaaacacauagcgauucuacauuguuagauauauguauauaccuuugaaaaagcccuuccucucuacuaaccugaacaguuauaagugggaggaguaagagagccgcaugugcuaccuaccuucagagcucgcccagccgucacuucguaagccaccucaguucugcucuucuuauuuuaaguagaauacuuuggagacugugaaacuuaaaucugcaggguuuuuuaaagaggauauguacagcuagcuuuccacucuuaaaaccaaaccacagaugacacauuuccuuuccgcugcaacucaacuacaugucacggggaaagcaaagacugacuuguccagcuggcaaugggaugacaagaggcuuuguagcgccagucuccacccccugaauggggagggcuuuccucuuuccuuccccuucccccuuuucucucccaccuauggcuuauuguuuaugccuacuaucugcuuuugaaauuaguauuauucaauggaaauuacaugauggcaucuuuaguguggcauuaaaaucacuuuucuaauuuuauaucacagacugauuugaaaacauaaaugugggguccuuggagguguuugucagcuaggaggaucaccgaguccguggagguguuugucagcuaggaagaucacacacaucacugccguuucaagcugcgaacugcagcagugaucugagcagaauuugggccagagaaugcuuguaggguguggugugugcaguugugucauugccucagauuagacacgucuguucguccgggauggauuacacgguuuugugugaaaucagauagacuccucugaugaucuccuugguucugcugaucguaccgaagccugggucacagcagauccccucugauccugucucacuacgauccucccuucagguuuucugaggugcuuguuuccucacuagccccacacaugucacgcaucucuaacgcugucuuugaucaucuccucccuuuuucugaaugagcaccacacuaaucuccagggaucauuagacacuuucucaucuccuuaaaaagaugaccacuuuuaauuuauauaauuuaaauuuuuauuuauuuuuauggugucacugggacugaucgcaguuaucuacgccuaccuuuauguagguuuugaugucaccagguuugcaugaccagcaccugcugagccaagucuuucacaccuccccuccuuuuuauuuugagucaaguuuauuaaguugcccaugguagcuuugaauauuuuuggguuuugcugguuuuccuuuuuuuuuuaaaucuccucucacaguccaucccaaccacagcuuccccucccuccucuccucagucugccccguaccuccucuuucccagauccacugcuccuccauuuuccuucaauaaagagcagccugaaacagcuucuuguggaguugaaacuggccuagaacucaauauggagcugaggacgaccuugccuuuauggucaucuugccuugcucccaugugcugggaucacaggcuuuuaucaccacauccaucugagcgcuaggaauugcaccuaagcuuucauacauccacuaggcaaguacucggucaacugaccaaugccacagccuccuugauucuuacuaaaagucaaaaaaguugccuauauuuucaaaagugauuccaaaauauuugcaaaauugagaauauuguuuuaaagcagcaaagugucaugcucucuacauacauuuuuauuaguaggccugugcugguaccagccaguugauuuccagcaagcaggauagugggcucugacacuggcaguccacagagcauagcuugacaaauauccacccccaggcaaacacugaggccuuucugccccucacggcuguugccuuccuuuguuuacaucugcaucucuguaagcucaccuauguggaucucauucucuaguuaguguagaacacacucuuuccuuuccaccucuccucaagccccacuucucuuuucuguucagcucaaacuuccuucuaucagagucuacacuggauuuuuaaaauaucuacauaguuuucccuauauauuuguaauuucacguuggucuuaccuucuuuugaaugucacacuguuuuuuuccccucuguuguuucucuugugagugauauagacuacaucaugcaggcugaauuuguccaaagugcuuaaauccaaauauuugcagguuuagauuuccuucagauuuugcaauauucacauuuacauacacauaaaaugagauuuuagguggauagugaaugcuaaacacaaaauucgucuguuucauauguaccuuauacauauaacugaaggcaaaguugcacuuuaguguaucuaugguuugagcauuggguuugaauuguccacccuggcaucugauggcauucagaaaguguuuuucagaauaggaauagccaaccuguguauuuucuuuuucuuuuuucaacuuuuuguuuguuuauuugguugguugguugguugguugguguuuuugagacaagguuucucuguauaacccugacuguccuggaacucacucuguagacuacgcuggccucgaacucagaaaucugccugccucugccucccaagugcugggauuaaaggcauucgccaccacugcccagcuuuuuucaacuuuuuaauugacugugaguuucaaaucauguaccccacagucccaucuccucaugcccuuguauuugcccuccacgcuugcaaaccucacucccaaagauaauaaaaaacaaacaauaaaugaaguaaacaaaacaaagcauagaaaacaucucaucauggaagcuguaguaugucacagugugucccacaguauaucccugugcuucacacaucuucacuugcaaauguucauugcaaugagucauuggucucuuucugaggucccuggcuucugucacaccaucaguauuggauucucauugggacuccucccagacaucccauuguugcccucugucauggaguuccuucaggucuggaccaacaagauugucccuuucaugagcucccccaguucacagauaauaaagauuuagggaugggccaacucaaagcccuggaucugagccuagaugauagcuaagcucaucagcaugccaggucuuuuuuauccacaccaccaggggcaagcucucuagcacugcugcagcuagcccacuuaaugcugccgucgucaagaggcagcgucaguucuccugcucgcaagcccucagagaggcuuauccguacucacaccuccagagucagcccagcugaggcaugggucccacucucucaagugcugcagauagcaaagggucaggccaguucucacccucucagggcgggcccaccugccuucucugugagggccagcucuacuauauugagcaggcaaggugcagggccugcucucccaagugcugcagcuggugguggugccaguucacucucugucaugaccagcucucccagcugccucaaguggugggggggggugucuuuuaucauuuauucuuuuuaaucuuaaacuguuuguuucauuuuaaaaauaauuuaacuugucauuuuauuuuuugacaagauuaaaaguuuuuacaugaagauacuuaucauaacucagagauaauggagcauaaggaacagugggccugaguuagucaagcacagcacucuuccgagcuuccuucugugccuacuugugcucuuucaguugugagccaagugugccuggggaagcgggggaaacugcgggugaauguguaaggaccaaaucaaguccugaggaaugaaugguguuugaaugccucagguccauggcaguggcaaagcuucucucacacacccccauacacccauggugggcugggaaggacugcagagccguccucucgucccuaggauguuggcaggguguacaaauaugaguguuuaccaacaguugaccagugugugccaaaguuggcaauugcagcucucuuucccccuggucgguaaagcuggagacugcucacuuacagaagucuccugucaagacuagguggccucgcuguaccuaauacauuuccugaggguuaggcuugcugcaguuguuggugcagcaccaucagagugcacacagcccaccuccccccagcuugucugcuugugcauuugugucagcccuuucuugauuccuucacugcuccagucagauuuccaggacccaagccaaguggacgugguguaugaccuaaugugguuuaaucaaaacauggaacauuagcuuauacagcugaacagccuggauaaaucuaaccaugggggagaauuuuaucuaugacucagauuauagccaaacuccagacugucuuuucacuucucagcuccuucucuuuggguuuugaggaagacuuuuccuuccuaucccaagauaaaauuuauaaucccucggcugagcaguaaugaugcagcccuuuaaucccagcacucgggaggcagagggagguggaucucugugaguuuacaaagugaauuccugcauagucauagcuacaaagagaaacccugucuuugaaacauaauaaacaagcaaacaaaucccagggcuguguauuuucuuaauuacaaacauggagaaaagcucucaaacccccacaauucgaacuaugauuuagccugggauuuaagccucuggcuucauuguccugacuugagucuuuguguucauugcugagccaccuucuguucaaggucagcuccauggauuggccucagcuucugagcaucuuuuccagccacuggccucucugaggaguacccagugucuuucacugucuucuuucuugauaggcagauuuguugcuauugccauaauuuuuaaggaguuuguuucuucucucuuuauccuuauugcuuaaagccuggaaaauauaaaacaaaaaaauccauacuuugaagacuuguuuuauaucauuguucucuuuagaaaauuaaucagaaccagagagauagcucagcauuaaaggcuaagcucagaacuagaaauaugaaaagauuaacgauaaaauuuuucaaaggggucagugagauggcccaacaggugacgaugcugucauuauaagccugacaaccuaaauccagucugcacagcauaccugguagggagcgaggggagcugacucuugcccccaugggugugcuguguugucuucuggcuuccacacgcaugcacacgcucacaccgacaugcacacacaauuaguaaagguaaacaaaaauacuuauauucuguacauucagaacauuuuaacaaucuauccuuuuuuuguugccuuccuuagguucaaaacuggccagaucaauggugaucugcugauauaccaugucuugcugacuuuaaagccauauuaugcaaagccauaugaaauuguaguggaccuuacccauacugggccuagcaaucgcuuuaaaacagacuuccucucuaagugguuuguugucuuuccuggcuuugccuaugacaacgucucugcagucuauaucuauaacuguaacuccugggucagggaguauaccaaauaccaugagcggcugcugacuggccucaagggcagcaaaaggcucauuuucaucgacuguccugggaagcuggcugaacauauagagcaugagcaacagaaacucccugcugcuaccuuggcuuuggaagaagaucuaaagguuuuccacaaugcucucaaguuagcucacaaggacaccaaaguuucuauuaagguaaccucuggucuguuuuaaauauuuguugccuuuccugacuaaccagguuauauugugaucucuacaaauguucucauaguugcauaucuaauauuaguuccauccagaugugggaagaccaagacuucuaucuuuauugugguucuacagaaaauugcacacuuacaagacacucucauaaagccugagugguggcacagugguuaagagcacuggcugcucuucuagagauccaggauucaguccccagagcccgcauggugggucauaacugucuguaacuccaguuccaagggaucuucuggcucccgaggacaccaggcacacaugugaagcagagauauauaugcaggcaaacacucauacacacaaaauagauuaauuuuuaagguacuuaguuuggguaaggggcaaaaaaaaaaaaaaaaaaaaugcuauagacugaacucugcccagugguuggcuguguggaauggaaaggaccuggcgacauaguucuguugauugcaucaugguuuuucagaguggugaguuuuacccccuucaguauuuauaaaauucuuggccuuuuuuaaaagaaaaaugauuuuuuucuguuggauccaguuucuuuugagaguauuuauaaguaaguguuaaaguaaacuaaauaaucucauagcuaacauggcguggggggggaaugaguuggguuuuggagcuucugagaauucuguguaacuggaaucuauuccuuccucacaccguuucucagguugguucuacugcuguucagguaacuucagcagaaagaacaaaaguuuuggggcaauccgucuuuuuaaaugauauuuacuaugcuucugaaaucgaagagaucugccuaguugaugagaaccaguucacucuaaccauugcaaaccaaggcacaccacugaccuucaugcaccaagaaugugaagccauuguucagucuaucauucauaucaggacccgcugggagcugucacaaccugacuccaucccucagcauaccaagauucgaccaaaggaugucccugggacacugcuuaauauugcguuacugaauuugggcaguucagacccuaguuuacgguagguauuucucucccacccuuccuuuuuuuuuuuuuuuuuaauuaaauucacuucaaguugaauaguaucucacuguuguuaacugagugccacuguuaagggcaagggaaggccuaaaguuuaaugaaucggauacauuacugcguccuaccugugucaucucaggaguuuucucuaaagaaaucuucuggugcucuuccuuugccucagcaacagagcaacaugaacaaaaagaauauuacugucuggagagcaucacagucaaauaccacguucugucgcggcuguggccaagugcaaggcaauguauaccuggaaacugacagagaacacugcugggcaucgugcaugaggcgccuaggcauugucugcugcacagcucaggcagaagcacagcccagccuguagacucagcagaugugguuugguggggagcugcuauguuguaacacagcuugcuuucaggcacaguggggaacucuccuuuuugguaaaauauugguaacaaugccuuccuaauguaccuaucaggugaagguuugacaguagcauuugcagucaggucuauaacacaggccaaugguuugugcuuagcgaaugguguuuucccacuuccuauucccaccuccuuucucuuccuuuucuuuccauguguggaugauucuuuaucuucgguaucuuaagaaggucgagaauuucacuuauggagguagaacuuuccuagucugaauuccaagacgcuccagaaucugaaaucucuuauguacuuuguccagacuuucugacaugucacuuuauuaagacgagcucucucuguguagcucaggcuggccaagaacuugcuggaauuaaggucacuuucaccacccccaccccaauuucagagcuuuuaaucauagaugcucauucugcaaaaucuauguaaauauuucaaacccugaacauaucugaauauggucauuuuagauaagagaugcuuaauucucagauucaggaacucucccuuaggauauaacauaacccaggguuuaugcugggccuuauaagcuuucaaauuugccuuuauuuagaaggaaaaaaaauguguccagcaagaugucucaguggauaaaagagcucaucacaagccugaaggagagaacuaaaucccaaaaguuguucuuugacuuccuuguauguguccacaugcaugcgugcgcgcgugcaaacacacacacacacacacacacacaguacauaaaugaauaaauguaauuaaaauuuguaagucagauguguaacauauguaucugauaccuguacucagaagacacacacgaguggaucugugaggucugcauagcaaacugugggauagccagggcuacauaauaagacuaucucaggaaaaaggaaagcaggacaauagucaacagauuuauuuuuauuuuuauguuacuuccauaggccucauggacucucacagauggcuugguaaauuguauguguacuuggcucuccuuaccuuagaaggcucuuugacacguacccaaguuauggaagcccaguuuuuuaugacucuuagguaauauaaaauagcaucagcauaguaugacuuaucagucagagaaagauaagcauaaauucacagacaguaauauguauucucauguuuagggaaauugagcuauaaggccugucuuuacuuuucgauuccaaauagaucuuuauuguuuaucaguuggguauuuugucuuucuaaccuggaauuacaguccuccuggcgcugcuuccacugaaugcuagggguacaggccugugccacaaugccuugccacuugccaucucuguuaaauaaugcuaauggccaccuuggcuuaagugaaaccaucccacuuuccaaguuaguaaaggauagcaucccagagaaaauaaaacaccuuugggcaaacgucccaucuccauagcuuuuccuccugugucaacaugucagaaacucagacguagugaaagccugaaguucacugagaagcccagcuguuuguuuugcugcauuuuaaaacugagccugauggggguggguggguaugggggacuuuugguauagcauugggaauguaaaugagcuaaauaccuaauaaaaaauggaaaaaaaaaacugagccugagauuuggugggguggggugggguggggguggaaugacacguguuauuuugaagugcuagggauugaacccacaggcucauacauguaaggaaaccauucuaccucugagcugcuacagcgcaaaccucaagacuuuguuaauuuuuguaguuugcuuaaauacauauguauguauuuauaauauacuuucuguucuaauagaccauagguaauacauuauugguuccagugguuauagaucauagauuaaggucauagaauagaaaauguaguugcagcuuuuuaacuagaguuaauuuuuguuuuaaccucugguuuacaauguaaauuggacaacauaaacauuccgagguuauccuuacuuuaacacuuuaaacauuauuugauuaggugccucuuguggcccuggcuguccuggaacucacucuguagaccaggcugcccucaaacucagaaauccuccugccucugccaccggagugcugggauuaaaagcgugcaccaccacugccuggccuagaugccuccucuuaaaacauaaaguucucuugcuauguagcccugacugucuggaacuugauguagaaaaggcuggccucauauucauagccuacaucugccucccuagugccaagaugaaaggugugcacugccagaguccuccucacucuccuucucuguuuaauuggaucugugagcauaguguugacuucacucauaauacauggcaugccuuuauucagucauuuacuucuauugaucacccaagacccuaaaucuuuacugguuuaugcucccaugaagauuucuaggaaggccagcaccucuuaagaguguccugggcucuucucguccggcgcugacuucaggacugguuuuucucacucuccuguuuggggcuugccgcacauucugccucuagucaguuguaacacugagaaagaaucgaccgugcuuugugauaaaaccuagaguuguauguuguggggaaaauguaacuacaaacaaagaaaauguaaaacaaucuccuucaugucuucucuuaggucugcugccuauaaucuccugugugccuuaaccugcaccuuuaauuuaaagauugaaggucaguugcuagagacaucgggguuaugcaucccugccaacaacacacucuucauugucucuaucaguaagacgcucgcagccaaugagccacaccucaccuuagaguuuuuggaagaguguauuucuggauuuagcaaaucuaguaaguaaugacuuuccuuaauauuaaaaaugacuuuuaagacaauucaaagaaaacucuuuuguuugggaauuuacuaggagucucucacuugcuuuuuuuuuuuuuuuuuuuugucugugguacccuguaacuaaaggaccucugaaagaaaauccuggugggauguacaaagagaccuaucagaacucugugggacccucuucccuguaggcuguuggacagauuuccuucuuuauuucagcgccaugaacuuuaccacuucuuuuuuuagauaagauauuaaggaaauaguugcuuuuccuuuuauaguugaguuggaacuaugauuuuuauuggacaucuguugguagaugaugccagauccagagucagcacugaguuuguuuuaauaaauuucauuaauuuaauauuuauucuuuuuaacaucuguccuccuucauacccuguacuaacauagcugcugaucuuugccuggcuuaguugcugacauuuucuucuccauauaauacauacagcuuuucccccugcauucugcauucaaaaucauaucuuaauaucucaguauuaggugauuaagugcuuuaacaguucaucaagacugugucugauuggagcuggagagauggcucagugguugaaagcacagguuacucuugcauaggacccugguuugauuccuaucacccacauggcagcucacagccaccugugaagccaguuucaggggaucugaugccuucuuuuggauuuuucaggcacugcaugcacaugcugcacagacaugcauacaagcaaaacacccuuacauguaaaauaagauaaauuaguuaaaagauaaaaagacugcauagguacguuuuguucuauuuuuuuccgucaaguggaagauguaggaguguaacucugaagagagauuguacauuugagaaacaagaaaaguacaacguuauuaguaacuauaaaugcgugaagauaccugagugaguggacaggcauacugugucuugcacaaacagcucuucugggacuauuucauauuuaauacagucccaucaaagaguuugaaauucccauggaauuugaaauuuucaaaauauuuuaaauuuuacugaaaauaaacagcuaagaaaauguuauaaagaaagagagugcagaugugauaguacagaugucuccucacuuacauguuguaauggcauaguaaucaaaacaugaauguucaaaacucagccagcagaucuauuuaagagaaacagacagcucaagugucacaaacugauuagugagaugaaaucacuuaagaaauaaguuugaaaaguguagguuaccuacacaaaacauaccaguguaaguucugacugcauuuagaagcauugguagagguggggcuuagaugcuuuuaugugaguagugugugugagagcagcacacccaggaggaaggugcagggaggaaggaagagaucgcuucacgagacucuggaagaucuccacagaaaaaagaacacaccggugugugacuaagcugggcugggagguggcuucacugaacauggaaagauuaacguccuuaguucagggcuccucucuguagcuuaguaaaugagucacgguagcauaauacuaaaaaaaaaauauuuuuaaguuuguuaauaaaaauuacauauugaaagaauugugaaaaacgucuuuuaaagauuaaauccugagggucuguagcauuguaaacaagaacaauguuucuagaaagacauuuagaaguagauucgacccuuaagaauauuuccaucuggggcuggagagauggcccgguggauaagagacugguuguucuuccacaggugccagguucuauuuccagcaccaacacggcagcucacagcuguauaacuccaguucaguggaugcaguauccucacacagacauaaaugcaggcaaaacaccaguacauauaagauaaaaguaaacaagauaaaaauaaaguuaaagaauauuuuacauuuuuugacauuauaguucuacuuuuuaauauuuuccugaaaaaaaucaaugcuaaggaaccagcaagauggcacaauaggaaaagugucaugccacaaagccugauaaccuaacuucaaucccuggggcuuauguaaggguggagggaagaagccagucccacagaguucuccucugaccucaccaggacacacauacccuugcacacacauuuuuuuuaaaagaauuaaugcagagauguuuauagcauauuguuuuucuguugcuacuuuaaaacuaagauauaucuugucauaguaacguucccagcuguuaagugaguagauguuaauuaaugagcuuugacagggaauaaucaugaaaagaucuucuagaucauagccuauaguauuccuaguguccgucagcuucucucaguaccaccuccucaaacucagagauccgccugccucugccuccaagugcugggauuaaaggugugugccaccaccuucuagcuuggcuuucuuacuuuaaauuuaguuuuuuucaaagugucuuuaccucuuaucaaaauguuugucuaggccuaauucaagauaaaaaucuuuaucuucaaccuucucucugguccuuuguugugggaaauauuaaaaaagagagagagaccauuccgcgcuauacccagcuacucucuggccccagaggucucagucuugcugcuuccacuagccccagcuccaguucaccugccucagagccgcuuguaccuuuccagccaucuacgcccugcaacuagccaucacaaauccccuuaacccaguaaaucaaacccccccccuuuuuuuuuaauuggauaucuuuucuuauuuacauuucaaauguuauccccuuucccaguuuccccucuggaaacucccuauccuacccgcccucccccugcuucuaugagggugcuuacccacugcccacccacuucugccuccccacccuggcauuccccuacacuggggcauguagccuucccaggaccaaaggccuuuccucccauuaaugucugacaaggccauccucugcuacauaugcggcuggagccauggguuccuccauguguaauccuugguugguggcuuagucccugggagcucugggagaucugguugguugauauuguuauucuuccuauggguugcaaaccccuucagcuccuucaguccuuucucuaacuccuccauuggagacccugugcucaguccaaugguuggcugagagcacccaccucuguauuugccaggcucuaaaagaggcucucaggagacagcucuaucaggcuccugucagcaugcacuucuuggcaucugcaauaaugucugguaucuguauaugggauggagccccagguggggcagucucuggauggccuuuccuucagucucuguuccacacucugucuccauauuuccuccugugaguauuguguucccccuucuaagaagcacugaagcauccacacuuuggucuuccuucuucuugggcuucauauggucugugaaauguaucuuggguauuccgauauuauuuagucuaauauccacuuaucaaugagagcauaccauguguguguucuuuugugauuaaguuaccucacucaggaugauauuuucaaguuccauccauuugccuuagaauuucaugaagccauuguuuuuaauaacugaguaguauuccauuauguaaauguaucgcauuuucuguauccauuccucuguugaggggcaucuggguuguuuccagcaggcuuuuauaaauaaggcugcuauaaacacgguggagcauguguccuuguuacauguuggagcauccuuuggguauaugcccaggaaugguauagcuggguucucagguaguacuauauccaauuuuuucaagaaccuucagacugauuguuguaccugaugguuguaccagauuacaaucccaccaacaauggaggaguguguuccucuuucuccacauccucaccagcaucugcugucaccugaguuuucaaaacucuuaaaacuuauaauuaucagucaguuuuauauaucaaugaauucucaauucccaagaugcccauacaauaauuuuagagccaguugauaaugacacaagcugcccaccuagauuagacagguuaucccaaucauucuauccuucuaugauauucauagcuaucuguggcuauuuaaagccacauggaaucugaauccucuuucucuucuguucucucucccguugcuaaaaaucuccacccgccuuccuuuuccacugcccaaucacaggcuucuugcuggguuaauauuuaaauuaacuggaggaaaauucugcugcauccuucaugacugaaucauuccugaggcuagagagguggagcagcuguccuggcuguuccuucagaauaccuggguccgauugccaguacccauguaauggcucgcaguguuuauaacccauguaauggcucacuguuuauaacccauguaauggcucacuguguauaacccauguaauggcucacuguguauaacccauguaauggcucacuguguauaacccauguaauggcucacuguguauaacccguguaauggcucaguguuuauaacccauguaauggcucacuguuuauaacccuggucccaggggaucagacacucuuuucuggccuuauuggacaccaggcaaguauguggcacacaaacauacauguacacaacauacucaucauacacauaaaaauuaaaauguuugucauuuucuucuacuaucugugcuaauggaguauuuucuucacagguauugaauugaagcaccuuuguuuggaauauaugaccccauggcugucaaaucuaguccguuuuuguaagcauaaugaugaugccaaacgacaaaggguuacugccauccuugauaagcuaauaacaaugacuauaaacgagaagcagauguauccuucuauucaagcaaaaaucugggggagccuugggcagguauugaauuuacacugacacuuauccagugccucuuuugugcuaguaauucuugguuuccauguuacacagagcacccuguucugucccucagaagcauguagacacauacccagcccuguaaauagcuaaugcaucucagagcucucuuccuugcauaauuuuauagaguuuagcuauaggcaccugucgucauuccuaguaaauagcaucuaaauauguacuuagucucuaucaccacugaugucugucacuucuucucagugaugcuauuuacaacaucugcuugcauguauaguuguagcauagauacaacuuuccuuaaccugacaagggaggugcacguuauuccuucaaaauaaucacuuaaggaagcagugcccuuaacuuagacaauguuguaaacccuauaaaugauuuuaauuggcuuuggagccauuuuucugacugacugguauuauuaaaguaauuagauuggucauguguuacugucuuggagcacagacauagugucuaagcagcugaagauagucgugcaaagaugcuuaaccucugaaggagucaaguggcacccucuuccuucccugcaugguuuacaggucucuuaagucuagaacuuugaaagucucuaguaaaacaagauguccauuacuugggcucuuuugaguauuucuucauuaaaggcagcaugcuugacagcaacaugacuugcuugucucaccagaucacagaccugcuggauguugugcuugacaguuucaucaagaccagugcgacaggaggcuuagggucuaucaaagcugaggugauggcagacacagcuguggcuuuagcuucuggaaaugugaaauuggugucgaguaagguaaccacuuuuucuguaccucuuggacuaugccauaguauaucuauuuaucaucuugagaguuuuugucuuauaaccagcuaaguuuaaacagauuugagugagagugugugugagaguguguguguguguguauacgugugcaugaaugucuguguacacgcauguuguggcacacauggaggagucaggauaguuugugggagucaguuaucuccuuccaccagauggcccccaagguauggagcuggaugcugugcacccuaaccugccgagccgucucauccauccugaauuuauuuuuuagauuugcuuagguuucuuuuauguguaugugugccacauguguacaguguccgcagaaaucagcagagguugucagaaucccuggaacugaagcugcagaagguugugaucugccaugugggugcugggaaccaguguucccucuaagagcagcagaugcucuuaaccucugagucaucucuccagcacccucaauuuuacgugugauggaacuuuuagucuuauguuuguaaaacuuguucuucuuuacagguuauuggaaggauguguaaaauaauugacaagacuugcuuauccccaacuccaacuuuagaacaacaucuuaugugggacgacauugccauuuuagcccgcuacaugcugaugcuguccuucaacaacucccucgauguggcggcucaucugcccuaucucuuccauguugucacuuucuuaguagccacaggucccuugucccuccgagcuuccacacaugggcugcucaucaauaucauucacucucuguguacuuguucucagcuucacuuuagugguaagucccuaggaggugaucucgcuucaccaguucuuucucagcuuuaccuuaccagacugcuauagguuucucacuguaauaguauugacucaccaggccuacaagcaggaauuugaaauuuuaucaaacaagaaaauaauaaaaauaacuugcacaccauagaaagcuacaauaagggcuuucuuugucaugcagauacuuguaauuaucauauaaccuaaaaguuuauuauuaguugauaguguuggcauuacuagugcagguuuauuauauagccacuaauguaaugcaucaggaauuugauuuagggagcaugguugugugauuuuugcaugauauuuacauuuuauuuaguugaagaugaaacauacuacuuuagaguuaaaauauuggaauuuucuuuuucuuuuacagaagagaccaagcaaguuuugaggcucagucuaacagaguucucguuacccaaauuuuacuuacuguuuggcauuagcaaagucaagucggcugcugucauugccuuccguuccaguuaccgggaccgcuccuucuccccuggcuccuaugagagggagacuuuugcuuugacgucccuggaaacagucacagaagcuuuguuggagaucauggagguauagaaagaaaaaugacaagaaaccaaauuaaaaucguauuuaaaauguguaauaugaaagguauaaugucacaggagggagagacagguagauugugugaacuugaagccagcugaaucuauguagggaauucuaggccagccaagccuacauaauaacaccucaucugaaaaaaaaaauucuguaauauacagaagaaauacugguuuauucuguuacaguacacacuguccuuuagaauguguucuuucuuuacauuuaucuuacuuuauguaucugaauguuuugcuggcauguauguguguacaccacaugugugccuguuguccaagguugagagaagaauccagaagaggacaucaaauuccccagaaccaaaguuacggauggauaugaaccagucuguggauucuagaaacagaagucauaucuuuccucugccacaacaaguacucuuaacugccuagccaugucucuagccccuagaauguguuuuuuauagcagauaacacuuaaagacaugagaauauuaaauauuccuagaaacauuuauguacacauauauauuuagaguauucucuuuuucaggcauguaugagagauauuccaacaugcaaguggcuggaucaguggacagaacuagcucaaagguguguccuugguugaauaguaacuagaacuguguguguauuguugaaaguagcuauugcagcagcagcagcaaucucguauuauaaugugcauacacacaaagguuuucauaaguuccuuggcucuuuucauugcagauuugcguuucaguauaacccaucgcugcagccaagagcucuugugguguuuggcuguauuagcaaacgagugucucaugggcagauaaagcagauuauccgaauucuuagcaagguaccuauuccucuuuucccaaagauuuguuccaacuuacaguguauacuucaagguuuuaaaaacacacuaaaacguaauaaauguuauuggcacugcaauuauauauuuguuaagcauuuaaacuuuuuuucuuacugcaauucuuugaagugaugaaaucuuaccuaacuaccuuuaaguucaacauuguggcacacgccuuuaaucccagcacucuagauacagagguaggcagauuuauuugagagugugaggccaaccuggucuacguaagcgaguuccaggacguaauugaaagaacuugucucaaaaagaaaaagagaaaaaaaaguaucuucuaaaaggaguauuuaccucuuuuucuagucagguauacuuaaucagucuugaaagcuguauagcuuuaauauaaagcuaugucauuuguaauuacuauaauaacgcccuucuuauuagaauguaauauagaaauauuuuaaaaauaaguauagaguauucaccauuuguagaaauugucaaauaccuaaauguuucucagcuaaaucugagauuuauuauaggaagugauguuuuauuucaaugaaaaguaaaacaaagauuucuguuucucuaaaaggcacuugaaaguuguuuaaaaggaccugacacuuacaacagucaaguucugauagaaucuacggugauagcacuaacaaaauuacagccgcuucuuaauaagguaaucauugauauugauucugcgugugcuuuucuuauacagaguuuaggaaauaggguggauugaaaagaguauaaagaagaaauuauagucagcauggagccucuugucacagaguuagaaaauaagggguaguggccuagccugguggcccacaccuuuaauccaucacucacgaagaagcagccuggucaacauagcaaaucucaggacagccagggcuacauagaaaauacuugucucaaaaggaagggagguggguuggagaaagaaggauggggagagaggugggguagagaggaaaggaaaaggaaggguugauuggaaagagacaaaguagagccugugucacaagucuuaguaguuugaagaagaggaagaagaaguauagaguaucuuuucucccgugcuuguuugugauauuuuuuucucuuugguacuagaagaaaguugagcugggugguggugguguaagccuuuaaucacagcacuuagaaggcagaggcaggugaucuuugugauuuugaggucagccugaucuacagagcaaguucaaggacagccauagcuaccuagagauaaugcugucuuggggggugggguggggagaguugaguaucauguauggaucugguagugcuuagagauacacagaguucaccaguggccugggucuggguuggguauggaugcugagauguggacaaguaaaguagccuaccacucagugcguuguuagugaucacugcuggagggauggaagccaggagcagugccugcucaucagaggcgucugcaugcuggcuuaggguguaaucaaggaauaguacuuacucaguauguauuagacccuggguaccgucuccaccaagggagggggaagaguaggagggaggcauggaguacauaugaauaagaguuuauacuaguaagagugauacgaaguuguagugucuaacuagagcuagaaguaaguaggacaguggggugcuagauagaccaaccuuguagagaguugacagagaaaaguguaaagauugaguagaauuaacuagcauucaacagucuucaggaaggaguuugaaaugaucguuuccuaggugacaguaugguaaaaagcaggacacaggugacccagagaagggaggaagugccuguagaaggacgguuagccuggacacugucugcaguguaaccaggagguggcaggugucagucuacuauagagaaucugccaacucugggugguggauuugacauccagcauugggagaauccaggggaagcucaggcucucaggcuaacuuacgguacuuguaaucagauacacagagccagccaaugcgcaucggucuguucauaguucucagagaagaggaagcacauucacuuaguggguagccugcucugguuuaugcugcagcaucauggaagacagugugucuugguucaccucacucacuggagcggaucuuuuuuucuaggacucgccccugcacaaagcccucuuuuggguugcuguggcugugcugcagcuggacgaagucaacuuguauucagccggcacugcacuucuggaacaaaaccugcacaccuuggacagucuccggauauucaaugacaaggugcguaagcuguccucugaggucacauugcucacagugagucuucucuuccuuuucuccuauggcucucuagaugucagaagagguccauaaucuagauauuacaguaacguguuuuauugugaauauaguuccuuaguagcucacuaaaaacuguuuaauccauaguuccuauauaaaaauagccaaggacagugugcccuacaacuagugauuagaauagacauaaggagggccggaaagauggcucagcagcacugacuucagcacccgaauggcagcucacaaccaucucuaacuccagucugaggaaucuagugcccucucuggccuccuuggacacuacacauacaugaugcacaagcauacauggaaagaaacacccaugcacauaaaauaagcaaauacauuuuuuuuuaauuuuaaaauaauacugaagaggaauaauagcuaccacaccagguccugugcauucauuacugguuaucuuuaguagcauucuucauccuuguuuauuuuuauuuagugugugugugugugugugugugugugugugugugugugugugugugagagagagagagagagagagagagagacuauuuuuuucaguuaaucaauaagaaaacuuauuuuuauugacuguguacuugaaggaaaaucuguacaauuaguaacagauaagcaaguuggagacucgccagacaauuuuugccaagucucacuuuaaaguauaccauuagcagcccccuucacauugaucaacauagguagggguuggauuuugguuuagaguauagaggauaaaauaaagcagcccagaauugggcuagugaucuggcuuagcaagcagaggcacuuaccacccagccugacgaccuccguucaguucccaggccucacaugugugcugaguaaaugcaaaccguuacuucacagccaaugcaaaaguauguuccuuuuguuuuggagaaaaacaaauagcuuaagagaaaaaagaauguucuuuugaagaaaaugugugugcgcaugugcacacauucaaaauuaucuugaaaugaacugaucuauguggaaauagaacauggccugagugugaagauaccccggucuaaaguacuuguauguuuguauguuuguuuguuuguuugugguauagaauguuucccuucauguauaucauauguguaucacaugugugccuggucuggugcuccugagguuagaagaagggaacuucugaguuacaggugauugugaagugccauauaggaguucugggaagcguucucagguccucuguaagaacagcaaguacucuugacuacugugccaucucuccagccccuaagugcuugcucacuguacauaaugugauauagacucaaaacagcuggaaaucuaggaaaugugaaacuauguagcuguccagcagccacgugguaaacuggauuuaccugaaagaggggcuggaaauaagguaaggggguaagaaaaggauaaagccaagacaaagguucagaucaaggcucaaaguuuaauaauaagcauugcauauauaaaggaaacaaaaccacaaaauccacccccuucuucagcuggaguauguuguagagcaagaucaauacaagcagcugagacuucaaaguuuccaugggaaccugcaacugcagcuaaaacagaugucucuguccagguugauaagaccugucauggcgaauguucaaggucuguuuagucugcucaaggcugggaaaaaugcucagccuuuucaaggcugggaaaggccuacucaaagcugagaaggcuacaaaacuaaauuauagauagaagauaccuugaaguuuaucagucagaccucuguucacaaaauggaaaagaguaaagaaguuacuggaauaugucuggcucugagcuucuucccuucucuacuaacuucauugcucugcucuggaauugauugagaucauggugguugcaagugauggcuagcuauuggcuauuuguauguuaaggauauuuacaaauaaauaucugaagagauaauuucuuucuuaccuuuacaucagaguuaauaaagcuuauuaaaaucagcagacuauucucugggauguagaguuagaguaauagugcuuguccuucgguccugcuccuugagaggcugaagcagagccaguccuguaggaguuggauaucagcagacaaauguagcugggcauuugaugaguggcuguaauauuagcacuugagagguguugacacagaaucagggguuagucagucuuuucuacauagcagguucauauagcucagugguaagagugcuugccuagcauacuuaagacucuggguucgauccccaggaaccccugaccccaacauacaaaacacacacacacacacacacacacacacacacacacacccuguuguaaauuaaagcaauuugaguuaucuacuauuuuauuauuuaucuuuuuuacugucuuauaccaguuaaauauaguagcguaaauguucuuauaggugugucuguuaucuaaaaauaauuucucugaaacugaaaguacuacuuagccugugagagcuguuaaacacaaguaaaaaagugacuuuuuaagcaaaauaucugaaccaagaauacaaaguaugcuugggguucuaguacuggaaaacgagaaggaaaauuucugugcgaacuccaccaagugucuaucuccugauuguuuuuaauagaguccggaagaaguauuuauggcgauccggaauccucuggaauggcacugcaagcagauggaucacuuugucggacucaacuucaacucuaacuuuaacuuugcacuaguuggacaccucuuaaaagguaaagagacuuuuuguuagaauguuuuguggaauuguaucuagaagccaaaaguaacuaagaagaauugauuacuugagauaaauugcuguaaucuagcauauaugcuacacuuuaaaaugaaaaacauaucuguauaaguuguuucaauugguauuuaacuagaaucuaguuuacauaucagaccuuaaaagaacaaaguaguuaguaguaaaauucccccaagacuuaauugcuguguuacuaguuacuagaacacugcacaugauguuaugucagugugcauauugcgaauguuauuguacgaagaaggcuuagggaugaggucagucauagaacacuggguaacuuuccagcauugccaaggaauaaaagagauuuuucaguuuagagcacacugcuguuuggauaugaucguagacacucuuugacuuguuucuagcauguuuucuuuuauuuuuuuauuuuauuuauuuauuuuuuuuuuuuuuuuuuuuuuuugguuuuuugagacaggguuucucuguguagcccuggcuguccuggaacucacucuguagaccaggcuagccucgaacucagaaauccaccugccucugccucccaagugcugggauuaaaggcgugcucuuucuguguacauuagaguccugcuauucugguaccucucuuccaguuucauugcuguuucuauaguuaaccaucuccaacuagacuggagcuaaugugcuucuaccuagcuuuagcugcucauugccagcuucauaacuucagagcuaugcuuuaauaaggugcuuauuuauaaaauaaauaaauaauguuaaggcagaggcaggagaguucaaggccacccuaguccuuagcuuuauagugaaacacuaucccaaaaucaggaaaaagacaaaaaacaaaaauaaagaagcaaaaaaaagggggggaaauaauuuuuaaagauguauuuauuuuauacauacgagugauuugccuggauguauauauguguagcaccugaguacuuguuaccugagaacuagagguauaggcaguugugaaccccucugugggaaccaaauucugguccuuaauuucugagucauugcuguggccccaaaggagaaacacuuuuuaaauauuagcacccuuacuucaagugaaaucucaaggggagcucuaaugcgcaguuuuguuuguauuuauuucuaaccucuaugcuucuuuaggaaauggaaaagucaagaaugcccuuuguuuccuaaugccuucuccuuuaggguuucaaggaacacccucuucuacacauuuuagaguucuuaaucauauguauaauuaacuucacauuuuuauguuuuaccuucacaaacggcuauucuuggauggcaggaauuuuccuuuuguuguagaguuacuugucacagcauaagagcucaaacauuuguucauggacuaauuaacugguuauuuguuguuuuuuuucuuuuuauaggguacaggcauccuucaccugccauuguugcaagaacagucagaauuuugcauacacuacuaacucucguuaacaaacauagaaauugugacaaauuugaggugaauacacagaguguggcuuacuuagcagguaaacgcacguaauugacuaaaucagccugacuccacuguugucuuagaaucagcaaaugauguccuugccuagcuuuggccuuccagcuagucuuuaguccaguagaacacucacaguucaguccuuucguauuugaaaagguaaagguuuugccaaaauaguuuucauuauaaaagaauuugcacuggaaucugaaauauaucccggcaggccguuguagccuucucuucuguccucuauguaaauuucauaagcaucacuuguuauagucucucaaaauggacaugaugcuucggaccaaucuacugcugucuccacuccaguuuucuacagggcuucugucucuucaguaugaauucuuuguacuguuugaccugggcugccuguccagucccugcuauuuuuuuuaaagauuuauuuauuuaguuuaauuauaugaguacacuguagcugucuucagacacaccagaagagggcaucaguuuccauuacagaugguugugagccaccaugugguugcugggacuugaacucaggaccucuggaagagcagucagugcucuuaaccaugagccaccucuccagcccccaguccccacuauuuuauuaaagugcuuuuguaugucuucucugacuuucucuacuguauucuacucacagaaugcagacugagguaugguuugauggaagaugcccauucucucuuuaacaaauuuccgguuuugccagcuuguuuuguuugaagcaugcaaccuugaacaaaccguuuacauuccaaaauauuuuaucacugcauuucagauauaugccuugccuacuuuuugugauuauugaaagcagauaugcaaucaagugcuugagaaaguaagguguuuaucaaauugcuuuguuuuauguuuaugcagccuuucaaagcagucuguaaacucuugaggauaagucuaucccguguguuuauacacuucauccucucacucuccaggccuuuuuauguacauauaaaauaguacauaguaauaguaauagccucuuaaguuuggaagaaaugaagccuguuuuaccagcuuuuccuuuuccuauuagcucuacucacagugucugaagagguucgaagucgcuguagccucaagcauaggaagucccuucuucuuacugauauuucaauggaaaauguuccuauggauacauaucccauucaucacggugaccccagcuauagguaagugggcaggcucucaucauuacauagauggagucaggcuuuaguuuccaugugguggagaucggcagcagaggacucuaaaagggagcagaguggcagcuccagauggucuggcaagaguagcuaucaaaguuugcucuacaggucaugguauuuuauauaggcaguauuaaaguuauucuaaucugcucuuauauuaucauuaguucaccucuuuaaacacaaaacacuugaauaaggaagaaagacaaucuugaaaaguuugcagaaaaggaccuaaggaaaagccuaacaugaaauacaaguaccauuggaucccugaugcuaagaacuaagcgagggcaggagggucagcugaguggguaaaagcacuuguauucuugcagaggucucagguucucuuaguucccagcacccacgugauuguucauagccaucuauacccuaaguuccagaggaucugacauucucuuuggacuaccuuggauagcagacacauugcacauauacauacaugcaggcaagacacucauacacauagaguaaauaaauauuuuaagaaacaacgacaaaaagugauguaggaggguaaaaaacauucguaugaacuguuuauuauugucauuaccauuuaaaaccuuucuguaguguaguuuuauuguuauugcuuugaugaaagcucuaugugucuuuggcuggucuggaacucccuauauaaaguaggcugaccuugaacucagagagaucugcccccaccaaguguuaggauuaaaggcauucaccaccgugccugguuucugcaguguagguucaugugagagaaucauaaaauuaugacuacuguucuucauggcuuuauguagguuuuccccccaauauaacaugaaguuacauaaauuccaucuuugggguauuauucuauaaugugaauuaaacauaucauguuauuaaauuuacuaauaucuugcuuuuuuguaguaaaaagacuccuccccaaggacuugaccgagacugcaacaauguaugcaggcuuuccuaauaaacaccgugcugugcucagaagucuuauucuuuagccaaugccaugaguuuauuuuuuuuuuuuuuugacccuucuuuuggcuauggaaaggaaaaaguaauguuaccuguauucaggaaagcuuaauucucaaacuuaauuuuaucaguuuuuaaauaauucaguaauacaguugccuauuuagacuuauuuucucugauuauaaaauucaauguaauaaguucaagaguucuauuacucagcaucaguuaaugacaguguauuuauucuguauuugaaaagugcuaagaaaauggauguuacguguucucaccacaauaaaugacaaauauguaggguaauauauguccuauauuagcauauuuaggcauuuucaaauaccuuuuuaaaaaacauguuguucagcugggcagugguggcgcacgccuuuaaucccagcacuagggaggcagaggcaggcggauuucugaguucaaggccagcguggucuacagugugagcuccaggacagucagggcuacacagagaaacccugucucgaaaaaaaaagaaaggaagagaggagggagggagggagagagggagggaagaaaaaaaccauguuguucaguaaaaauguacaacuuuuuucuugucaaauuaaaaaguuuggagccauaugugguaguaaaugccuguggucccaacacuuacaagguggaacaggagguuuggaauucaaggucauccuagcuauauaucgaguuuuaggccaggcucagcuaccuaagaccuuguuccagugacaaacaaaauaggagcuagagguauagcuccguugguagaggauuuuuuucugguaugcagaaggcccugaguucagucccagugcugcagaagacugacugacuguagcaugcacaccugccugucucugacuguggggugcacaccugacuucuuggcaccuaggaaguagaaacaggaauggaagcucagugccauccuuggcuucauagcaaguuugaggccagccugggcucaaucaguaaauagauaagucguucuggguuucaccaguuuagggauagaauacuagccgugcacgugugagguuccggauucaaucccuguccugcagaaaagaaaaaaagcuuaauaaaauuaugcacuauaguucuuccuguuuaccugccuagggauacauuaagaguuauacacuaagagccagcuaucaugguacauaucuguauugcuagcauucuggaaacuaaggcaggaggauuagaaauucaagaccaacuuagagcacauagcaaguucugggccagccugggcaacuuaauggaaaguuaucuuaaaaaaaaaaaaaaaaaaaaaaaaaaaaggaagaaaaguuuuuguccuauggcucuuuaaaaugcaguuuuugaauuaauugauugccauuguuaggaaauaggacagcuauuaggaaugagugaacagugguuauauuuauuaucuucuuguuaauuaauucuucuaaauuguuucaauuuuucaggacacuaaaggagacccagccaugguccucucccaaagguucagaaggauaccuugcagccaccuacccagcuguaggccaaaccaguccccgagccaggaaauccaugagcuuggauaugggacagccuucucaggccaacacaaaaaaauugcuugguuaguuuaucuuuauuuuauauaaauuuucacauuauuguuagugugaaaaaugguuaguuacuuucccucuuggaaaauuaauugaaacuauuuagauugccaacuuuuuuuuguuuguuuguuuuuuugagacaggguuuuuucucuguguagcccuggcuauucuggaacucacucuguagaccaggcuggccucgaacucagaaauccaccugccucugccucccgagugcugggauuaaaggcgugugcaaucacugcccagcuagauugccaauauuuacuguuuugauguaacaaauucuugugacuuuugaauuuaauuuauuuuauguguaugaguguuuuaccugcauguguauggaugcauaccacauguguaccuggugcccauggcugcagaaggguguuauagcccuuggaacugaaguuacagacauuggugagcuuccugugcuugcuggggagugaauccucuggaagaggagcaaguguucuuacucacugagcaucucuccagcccuuguguggcuggcuccucuaagggaguugauuuuaauggaugaguuugguucagccgugucuucagacagagaauucagaaugagacuuuggaauggcuuugaguuugauuugguuuuuauuucuguguuuuuaaagucuauuuccaaguacuguggcuuuugauuugggggcccuggacggcagugaugagagugguuagcuaucuagaggagaggaagcacugcuguauagagggcugggaugcuaauguccccugaagugccauucagaaguagaauggaccgcccuaagagaucuggaaccauauaaucuuugaaacaacaaaacaagguauuuuuaauaacuauaagacaauauuccuuuuagaaauucuugucuguguauaugcgugcagacagguagagauuggaggcagucuuggacugucaguucucuccaccuuuaugugagaucugcgcauuggacucagguuaucaggcaacaaggcaggugcuuuuacccacuaagcuaucuugucgacccaaaauaaugauuuuugacaguucuaucaacauuccuaugagaaaugcuugcacaaugcuaagccuuucauguccaguaacugaugagugaguuccugaaagaggacacucgcugacccacagagcaagugugaggcagugcuugcuugcccuucauuggcugccacucuaaaucguuacucaaauuauugaugugucuaaccugugauaaauaauaugaguguggacucugguuacccauguaaacauacuuaguaucaugagauaguauuaugcaaagguuugcucauaaggaaauugguaagcaaacaacaaaguguaacacaaauaaccuuccaguaaaaguugaaaggagaaauaacaaaugccagccauuguuacaguucaguugagucugucgucucucuucuauuugaguucccuuaguuaauccugugucaucagugauuucugguuacuucguguuuugucauuauggauuuucauaccaaagaaguuguaagugaaaaacuaaccucagaaaaugcaguauugaauuccuucaaacucuguucuaaguagaaaaaguagggucuaugcucuuuagagaagggcuuauccuuugguaguuaugacuuaaaaucagcuggugacaacaguguauagcaguggcauuaaagcaguaaugcuuaacauuacugaggcucuuaggaaauuaagagguaauauuugagccagauuucagagauuuagaccaugcuagccagguggacggacacaggauaaggaaaggcaugcaugcaagaggaagcaugguaagggaagagagugugggagcaguggccgugggucagaacaucagagcaggugaaggaggcuggagaagcacagcguggcugugagagacaaaccagacagcuggcugcaugguagcucaacucuagucccagccuuucucuggcggcauuggagccagaggccggugcaucucuaugagggcaguauggucuaugcagugagugccagcagagccagggguauguggagagauccugucucaaaagaacaacaaagacuacagugauaggagauuuaccacaucauacauccaacagagaucuucauuaaggaaggaacaagaugcaucuguuuuauuuguuuguuuguuuguuuguuuguuuguuuguuguuuuccuacauuuuccugacagccauguagagaaaagucuuuuucaaggggaccauuuacaagauugauucagcaaccuaagaggaaaacccagagccagcacacacuaaggcaggagcugugugugaggucuguuuccaaaggagagugaccaggacagagagauggacggggugggagggagaagacuguaaacgauaucauagguuucuggucaggugugacugugcugcugcugagccucaugagguaaaggcaagcuagaggccagccuagccauguaauguguuucauggccguaccccauugguaaauaaaauuaaaaauuaacuuaaauggcacuuuuccuggcugagcugaaacuauuauuuucuacuacuaacuauauaucuggaggaaaucaaaccaguguguggaagaggccgcugcauucuguguggacugcaagacuugucacagcaacacagaaaggaagcagccuccguguccauccgcuaaugcacagaugaaggaagcauaguucuacagauccacaggcaguagccaugaaaacgaaauccuguaguuggugacagcauggauaaaauuagagauuaguguguuaauuaagccagacacaaaaugaaauguuacaugaugccccucuaaugugagagagaagauauggcucuuaugaguguuaaggacagagugaugucuuaggguuuccauuucugugaagaaacuccaugaccaaagcaacucuuauaaaugaaaacauuuaauuggaacuggcuuacagauucagagauucuguccauuaucaaaaaaggcaggaaacauggcagcguccaggcaggcauagcauggugcaggaggaaggucuaugucuuuuuccgaaggcaaacagaagacugaccuccagucagcuaggaggagggucucaaaguccacccccacagugacacacuuccuccaacauggccacaccuacuccaacaaggucacacccacuaagaguggcacuccuuggacgaagcauauucagacaccacagaugucaccagagacugguaggcacuaaggagcaagagggcuacugugcucuuguacucagggcgacuguggggagcuacagugcacaccuacauuucaaagcuagaaggagaguuuugagugugugucaccuuaaagaaccuaucaaugagcugggugugauggggcaugcccagaggcagguagaucucugugaguucaaagacacccagaacugugcguaaugugagacucugucucaaaaccaaacaaacugauaaauauuugaagaguuagauaauugagcuguaggaagagaaggagaugacagaguagaagaaaagggacaguaggacaagaucaguagcaucccuaccuccaagcacuguagaaagcacuaguaggcuucaggauccuuagcagugugaauacagucuaaccaccuaaucacucaugacuucuuccguuugcaugaaaggaagagacugaccugaguguagauuccuuuggccuugguauuugugauuugugauuauucauuagucuuggugcaugagggcaacagaacacugaacugucaaauaccacuugucagaucuuguaauaauucaauuaugccuuugaauucauuuaagauauauauuucagucuuuugccuuuuccuaugugugugcuucugagcauuaaaccaggggcauaagaauuccaggaagaccaacagagucaacuaacuuggucccuaugggcucucagagucugaaccaccaaccaaagagcauacaggggcugggucuacgccuccccauuuauguguagcagaugugcaguuuggucuucaucugggucuggaacagcugggucggggcugucccaacagcuguugugugcgcgugguuuauguucuacccaccaggcugccuugcuuggccugguggagagaaaaugucuggccuugcagagacuugaaaugccagggugggaguuacccagggggucucuauuugcuccgagaagggagggaggauggggaaaggauuucgggaggagguaaccuggaggggggcagugaauggaauguaaaguaaauaaguacgaaaaauaaaauuaaauuaaaacaaacaaacaaaaaauagggaacuuaacucacuagcaaguucucuaccacugagcuacauacucagccccagauuguuuuguagaacugcuacaagaagagacauccccugaguguaaugagcaaagguaaauaaaugcugaauaaugccauauaaauauuuguacuuaaauaagagaaagacguuuaaauaccagaguacaugauuggguauacccucaaagccaaggugagaugagacuacuuguugcccuuuugaaggguugugugucugcuuguuagcacuucugggcaugcauaucuuuacagauuaaagucacacuuuaauuuuucccuguauuuggagauugcucaucuguuagugacuguuucuuuuuuuuuuuuaagauuuauuuauuauguguaaguuacacuguagcuaucuucagacacucgaggagauagagucagauuuuguuaccgaugguugugagccaccaugugguugcugggauuugaacucaggaccuuuggaagagcagucggugcucuuaaccacugagccaucucugcagcccgacuguuucuugauaaccaacucaauuuccuuacuuaaaggggccauuuaaguuuuucuaugcuuugcacugaucaaaaucuaauccuuguauuuguuauguauacuugguggagucuaguuuauucuugggauagugaauauaaccuaaaguuccuuuuuaggcuaguaaagauccuccuuuucuggaaagcuguggggccagacgccuuagagaggaaacggagaauaaugcuaagaaacucugcuccagggaugucucagcuugcgcucaaaaguaaaagcuuaaauuauuagaauauugugauuuguagacacugugguuaauaaacuuucauauucuguaacuuuuguucauaggaacaagaaaaaguuuugaucacuugauaucugacacaaaggcuccuaaaagacaagaaauggaaucagggauuacaacacccccgaaaaugagaagaguggcagagacugacuaugaaaugggugagacacaaagcugauaaguaaugaagauggcugcaaaccacgggaagcacagugaagccacaguugcuuccauccaggccugagggcucaggcugcagugcagagcaugugcccuggcucaagugggcaggaaaagaaaucagccaguuaugccaguggaaugugcggaaggggcagaggcagcagguccacagaggccugggcuauacuugaagagacaggagaaucuccaugaguucaaggauagccuggucuacguagacaguuccagaccaguguguguggcacaacacugcaagucacuagcuguuauauugcugcauacauaacaacucuguaugauaguaauauugauaauuaagaugccuguuuaaggaacuguaacauuaagauguaacauuaaaauauguugaguaaauuauacuuugucuacuaauagaaguacuuacauuaauccauauccuacagcagaaacccaaaggauucccuccucgcagcagcacccacauuuacggaaagucucagucucugaaucaaauguucuuuuggaugaagaaguucuuaccgacccaaagauccaagcgcugcuucuuacuguucugguaaggggaacauccuccucccguccacucauucauucauucauucauucauucauucguccauucauucauuuuugaggcaggguuucacuaugaaacccuagcuguccuauaccucacucuguagaccaggcuggccuugaacucccagagauccaccugccuauaccucucaugugcugggauuaaaaauguguaccacuacuccuggcaggauuuuccuuuuugaggguuuuucguccuuaaauuuuuauucuaguuugcucuuagcaggcccuuaaauauggcaaacauggaagaaagauauuuucaugucauuaaaacaaaguuucaacauaaauuguuuaccuguuuuugcaucuuggcaggcuacacugguaaaauauacuacagaugaauuugaucaacggauucuuuaugaauaucuagcagaggccagcguuguguuucccaaaguguuuccuguuguguaaguaucuccuguuguugguuaaucgcccugucuuuaugucaggugcucuguaaagguguaggaaauguacuucucaguggugucuucugccuauagagugggcaggguggcuaccauuguuauccuagagagggaugacuauaguuuuccagguugagacuacgaagagcucuggagaggagcacaugcuuagcaugccagggccuggguuugacccacagcacccaaaacaaaacacagagcuguggggcuaaagggcugaaaagauagcucagcaguuaugagcauguaugauuuugcagaggacuugaguuccaguggccucagaggacacuaaacauacauucauauacccacacaagcaaacacacaugcauauacagaacugaaaagaaaaaauaaaucuuuuucuaaauucauacuuuaauaauggcuaaaguugcuuugggcuuaucuauuaccaaaaccaucuuugcuuuguuuguuuuguuuuguuugcuuguuuuuccuuaaucguauugauuuauuguaguggcuuagcuuaaugaguauuaauguacaguuuucucaagagcaaacugauagaucgcucuauuuaaaccagccuacaugacugucuugggguuggucuaaaucuuuuccuuuaaacauuguguuuauuuuagugcacacauacaugaauauaauggcacacauggagaggucagaggacaacuuuagggagucggugcucuucugccaccacagugguccuggaggacagacuaagcucaucaguuguggccgcugucaccuugcuccagugagccauugugcuaacccuugcuucucuuuuuauuagaauucuguacugauucauagcugagggaaaauagaauugcccucuucucuaggagguugguuuuacuuuuaauacuugaacuucaaagccuuugcucuaguuugguuucuguuacucugauaaaauacuguccaaaacaguuuggggaagagaccagagagauagcucagcaguuaaaagcaugccugcucuucuagaggauucugguacaacucccagcacccauacaguggcucacaacugucuguaacucuaguuccaggagauuugacgcccucuacuggccucuguggacacaggcacacauguguuacauagacaugcauauaggcaaaacugucauacacauaaaauaaauuuaaaaagaaaagaaaagcaacuuggggaggaaagguuuuauuucaccuauggguuacaauccaaucauugagggaugcuggggcagaaacuaaagcagagacuguggacuaaugcugcuuacuggcuuugcuaauuguggcuugaucaguuauccuucccgcccccuugacuggggcuggccuaagucucagugggcuguacccuccugcauuaguuaccagucaagaaagugguccacagaccauuuugauggagacggcucuucaguuaagaguccuucuuccuggauaugucagcugacaacuaugacagaaagguguuggcaaauuaaagaaacuuuaaaaggaccuuuguguggaacacagaacaauaaagagcuccaaggugaaggauaggucuagggcagaagucuggcuaaagccuuugcugugucaguguuaaauaucgagucguaucccuuuauacagugcaaagcuguuaggaaagcuuuaguugguagugagucgcugcacucugguguuaugcugagaaugaguuggaagaaacagugcagaugcgggaagauuguuguaaggauacuauuccaggagaccaauaucugcaauauaaggagagacagacuugaaaucacauauuggagguaaggauuacagaacuugauauuggacugaguguugacuaggguaguucccuaaagaggacugcuagauucauggcuugcagggaagaguggaugacaguggugacauacgucccagaagaaucccaugccuaugaaaggggaguagaaugaguuugguauuggacaucuuggaacagcuaugucaaacaaguaaagauacuauaguuagacuuugguuuaauaaacaugaauacaucacugcaguuuauugagcaucccacauuuguuguugucuaauuccauuuuaaaguuuaugaauuucacauauuuagguguugccuuuuuaaaauagauuuuuauuaauagauugcaagugaucuggaaaugguuucuuuguaagauuccccaugccaccccuuccaaauuaauuuuacuggccuaccuuggcacugguuaguauuaaaugucauuguaacccuggacguacauagaaacagacagccgaggagcuagagugcagagugugcucacgggcagacagagccaagccuguuuuggacaacguuuccuuguacaguuugacacggucgugugauagcuaccagguauuugcuuuacuguauuucccuaaugacuuagaaugacaacacacacaugcucauucacuggauaauuuagaaaagugccagaaagguaaaagucccugucuccaguuuugccauguuguucuaagggauauguauauuacacuuuccaguaaauccuuuuauuuaauguuccucuguuuacuuuuguuuuuccaggcacaauuuguuggacucuaagaucaauacccucuugucuuuaugccaagauccaaauuuguuaaauccaauccauggaauuguacagagugugguguaccaugaggaguccccgccacaguaccagacaucuuaccugcaaaguaaauacauauaccaggagcgggugcuugcugagccacagcugcggcccuguuggagaaugccuggcugcaguguagcugcgggauaggcuccugcauggcucucgcucuucauuucaucuucugauucuauuaguuacauguucaguauaacugcuugaccacuguaaaaaugcuaucuauucuaaggacauuuuagucgucuuugacacugauuuuaaaaugucuuauuaaauauaugcagaguuugucugucagcuauacagcuuaauuuuuguuacuauuuaaagcugccuugcuuguuguaagaguagcauuugauuuuuugcagguuuugguuuuaauggcuuauggcgguuugcaggacccuuuucaaagguaaacaauauuuuuuuuuucuaauuuuugauaagccagagucuuuaacuguacucaugagucuguuggagaauacacauuaccuucaaaccaaaguaacauuucaaaauaaaaauuguuuuagaaagauuuuuuccaaagaggcaauacauucaauauauugauauauuaauuuuauuuuaaguuagguuugaaaucucagaaggguauggaaaaccucuauaaaacguauucugccuguagaccucuguacauguggcaauaacucacacaccugucuugugacucgugaagagugugaugcaugguaaauacaccucagggacacauggcuacaucugacuaucagauuuguucuuggcuguucacuuucuuugacuggcauuuguugguauacuacaugaaauaguauuuaauuuuuuuguagauggucucuuaaaauaauugaaguuccuugaaggcagggcuucugccccacacccuucacacacacacacacacacacacacacacacacacacacacacacacaccauguccuagaugaagggcuguuaaaucaagaugaguuuuuuauacauuuuucuaguucuaagaguuggauuuaguuuauuuuguacugucuguugauaugcacagguugucauuaaaaagaugggccugaagucacagaagugugucaugcagggguuuuaacaggcggauggugggaugaugaugaugcucugccugucucaucugcuuugggacguuggcgagaugucacugccgaggacugcauugucuauaaaguagucaauuccucugucucugcauggcuuucagaaauugcagguucaucuggaagcuuuuaggggaagccaaauacaauuccuagcuguauguuccacaguucucucuaaauacuauuccagacgucccccuccccccuuaaugauuuagacuacaaaggaagaaagaaaaacaauccaccaagccccagauaucauuaaccuuuucuuggcuucagagggaacuuuuuuuuaauggagcuaaaauaauguccuauuuuccauuacagcaaacacaaaucccugacuaugcugagcucauuguuaaauuucuugaugccuugauugacacguacuugccuggaauugaugaagaaaccagugaggagucccuccugacacccacaucuccuuacccuccugcacugcagagccagcuuaguaucacugccaaccuuaaccucucuaauuccaugaccucacuugcaacuucccagcauuccccaggucaguaaaugugaucguuaugugauugugagcaaugauacgauaccaacauuaggaacucccuuguggucagagcauagcagauuuugguccuuucccuccugagguucacuucccauuucuuuccuauguaacugaauguuguuacucuucagagcugagugcuuuccaucaaguucuauagcagagggggaaaugcauagugauguucaguauccacagagauuuggaccaaaagcacaaacuaagcuauauuaccuacaagugaacaucagcuauacuaacauuacccuaaggccuuauaugccucuggugcaguauaagcaccauaaaacacacacauacaaagucuaguagucaccccacuuuguugcugguaacaacaggucagccauccaucagccacugacaagccugaaggucugggauuagguaaacaaccagacaaaaaguucucauaagaaaaaaauaacaucuuggagcugcggagauaacuagguugguagaguguuucccuugaaagcccaaggaccuguguuuaguccucagaaccuauauuuugaaacgguauuugugguggcucauggcuuguaaucgaggcacccaggagguugaggcagaagaauaccugugagugaauagccuacuuggagaguuccagccagugaugugcagguccacguguacacacacacacacagacgcgcacgcacgcgcaugcgaaaaggaaaucuuaaaccccaucauuauaaucuuuacuguagagucacuguuggaucaagugagaaaaguaggucaguggaauuuuggguuuuauuuauuauuuauuuacuuauauucucaguccagggucucacuguauagcccuagcuacccuagaacuuucuauguagaccaggcuggcccagacucauggauucaccuacuuugucucccaaugccaagauuaaaggcguguguaaucauagacaaugaaauuuagaacucuauacacugagcagucauagguaagaguccccgagguacugagagagaaaagcaggaacggcaccugcccagcuccaaguucaguugaugucugucugaauggcuucauaagcucugcuugagccuagaggugaugcccacugccuagugagcacaagcccugcugugugaacagagggaacagugugcacuggcccacggcugauguuugggucaggugcucaguugaaaagauuuucuucuaaguuaguuaaaauguuuaaaaaggauuucuuaaguuaccuaaguuccauuaccugaaaaggucaugcgguagucuauaaggacauucuuagaagugguguuuuagcaggcguuuucuuuauacaaaucaaaccauaacuauucugggcugcucgagauguauaaauagaaucuccauaaauacuugucucaguguacaugaacauuuccauucgugugguagucuggaagauucuaaagaaauaagccgguauaauacccaauccauaucauaaauuuacaguuacaaguucuaaacaguuacacucaguucuuacgcuuuguuccuaauuuacuuaccagucagggaauccuucuaucuccuagucgucugcccagcucuccucauguagucaguggguuuguuccaucacuuguucuguaggacaagugugaccccacacccgaauuagcaucaucugauguuagaggcauagcucuugagucuucccugccugcugggugaaaccccaaguauggagcccagucaaccuccucgggagcaugggugauucuucugcacacugggcuuugagaugcugccauaggcuggcugugcuccuggcccaugacuuauguugacugugacucacaucuggaaucccaggcaagagaaucacuuugaauuugaguccagaugggcuacagaaugagacucuauuuuaauuucaaacaaacaaaaaaacuacauagaacuauaugcacguauuacuuccugaaaaguaguuaaauaaagccauuuccaaaguaugaagaucugguuuagacucgacuauagagucgucgcuggcuuuuuacauuauuuggggagcauuugaagcaccccaggaauagcucccuggcugcccucagucucauggcaguccucagccucagccccuaaagucuugggauuacaaggugugugcuaccauacccagcugaauacuuaguuugugaguguauaggcacuuucacaaauuuaaagacuuuucuuagccaggcagugguuguacaugccguuaaucccaguacuugagagccagaggaagguggauuugucugaguuccagggcagccugguccacagagcaguucuaggacauccagggcuacacagagaaacccugacucgggagggagaaaaaguuuucuuuuacuuuuuuuuuaaggugcgugaauaauuuaccugugucuaugcuucuguacaugcauuucccgaggaggccggaaaagggcaccagauccucuguaguugaaguuacagauaguugggaacugccauguggaugcuggaaauugaacccagguccucugagagagcagccagugaccuaaaccucugagccaucucuuuaggcccuacuuucacacacuuaaagaugaaagaugccuucaauacagggacugauaguuugugccuguggguguuagaauugaguuuuaagugaaaguuauuucuuacuuauuuaguaguauuuaacacauucuaagacaguucuuuuuuuuuuuaaagauuuauuuauuauuauauguaaguacacuguagcugucaucagacacuccagaagagggagucagaucuuguaauggaugguugugagccaccaugugguugcugggauuugaacuuuggaccuucggaagagcagucaggugcucuuacccacugagccaucucaccagccuccucccccuuuuuuuucuuaaacauagaauuuauacuguauugcuuuguagaaaauaaccaaaauuggagccagugaaaggacuaacuggauagagauguuuguaugcaguucuguugccaagugugaaccgaccucaagaguugucuuuugauagccacacuuaaacucaugcaugaacacacacacacacagagucaucuucagcuacauaaugaguuccagaccugccugggcuauauuaugagacugucucaaaagaaaagaaaaaagugcauauauucacaccagcaggucuguuugaggccuuaccugccucugaggcucucaggguauuaaggauggugcaguguacucaagugacuuauuuuaaugcuuugugauacuucucauggugugcuuagaagagucaguaacuucugcuuauuuacagauuauuccuaggaaauuacugguuagaaucccauaaauaaagccagcuuccuucugcaaaccagggaagguagcaagugucuaacagcuuuccccugcuuuucgcuccucuggacaucauucccuucuuuguccucuccucaucccccugaagcuccucugcacgcucuaagccaacaauuugcauauagccucucccacuguggccuuauacagaacaucgcuuccucuaaacucaagcuaggcccacagcuugagacuuccccagucccuagaaguugaguugaaggcucagguacuugaaaacaggaacuugaaaagugguugcuuggugacauuucuggacauacagaacuauauaaucaguauggccuguuugguucaguugccacuucuaccuacccuguccuugguuaaccaaacacuauggggcaucagcagagaagcagaccgaggucuuugaggaagaggggauuuuagcuuagaaaauaguuguuucucccacccccaaaaauaaagcugaccccaucauaaaaccaaacccauccuaaagcuauccuaaaacuaacuguucugacucaugcuguaaagaaaguguccuuaacugacugucagcacuaagcagacauguagcagcacacugcugccugauucagagaggaccuguuggcgucuuguaaucuuuguauugcugcagagagaugaggaagcaguggggcagcaggagaagcccauccauucuuggauucccgcagugccgagucuguguguccagucauacaagggccgcuaaauacacccuugccauccaucucuccacagacgcuuuuuccacagcauaaacaucgccaaagcucucacacuuggcuucuuuuuaagacguuuuguguucuuuacauuagcuccgcuccaguaauuuuacaaauuccagcauuaaauugaaguccuauacauuuguccuaaaacuccauuugcuuauuauuuaaucucuuuuauucgagguauuagaaacaucuuagucuauuuuuaaaagauuauuuuaucugugcaauucagaaaaguucuucauauagauuguuacccaacuucuuagcagcccuguaagguaggcaguguacccuuaacccucggacugcgcagaggcgagagucagcauccaguggcuuaguggagggcaagcagcuggggguuccagcuucagcacccagaucuuucacucuuauuauagaggcagcgagaguucuccacccgauuaggacucagacuuugaggcuaagaaucuagcucagugguggagugcuguguguauacacaaggcccuggguucauucucugcugaaaaaagcagagcauaagcuuuauccuucagcgugcuugccagcucauacggagaaacguuuuccaacagguuugcucugcuguuuguagggaagugagcaaugcaguuugaacccaagugggcuccuauauaggugaugacaucuaaguucucccagacuacucagguauuuccuuacguguguuaguaucuuaucuguguguuauuuuccagacaggagcugcagcucaguaguaacacgauaagcauguucugauaccugccuucaaggaacucaggccauaguagggaagcaggcuagcaucugagugugauuuggcaguucuucucccagcucgugcgguccacaguguuagccaacaccugcugccucaucuucauccggagccagugcagcucgcugaacacugggagugcagguggucugcugcccugcgugcacguaacuggcgccugcccgagugcagcugcuuucagagcuuauaccagcaggcaugggacacagccgcuucagugugauguccuuuugguggcaccuucuggagucuuugaucucauggauuuuugcuuuuguacccauggaaggaagaagggaaggaggacuggugacuuagggauauaagaacacagaauaugaagcuuucaguggagacgugcaaggucaggccuuucucucaagugugaaguaaggccugugucagggcaggagccugcuccacgugagcagucugcgcccuucagcagcacauggaggcauuucuagauuccaccguagaggggagggaggugugagagaaugcugacaaauuaucagaagaaaauuaucugagugcuagguucacuccauuuccugggcccugcuuuccuaagacuguggguugguguaaauguaauucauuuuuauugcuuuuuaaaaaauaacucuccuagagcuuguuuauaauaucuaccuuuuauuuauucuuugacaauuuaauauacauauacagugcucuccaaaaauuuaugcaauuuuuuccuugauuuuuuuuguuuguuuguuuuuuguuuuuguuuuucgagacaggguuucucuguguagcccuggcuguccuggaacucacuuuguagacuaggcuggccuugaucucagaaauccgccugccucugccucccaagugcugggauuaaagacgugcgccaccacugccuggccuugaucauuuuaguaaaacuuuuuuguucuaauuaggcuuaggaauccucuaacacuguauuuauuugccuuccgacuuccucauuaggaaauaagauauagugaagagauuccuauuaaggaaauaaucucgguugaggaaacucgggccuugaagucacaggucacgugcacgugucaaagaugacagagugacaaccugugucaacuuccgagggaagcuggccgggaagcaucccucuuucuaauguacauggugccaaguaagggcugcacgcaugagggcugugaauuagagggccccagcuaucacauuuuaaaguggaaacauuuguugcaaaccaauaguuauugaaagugauuagcuagauuuuauaaagaaaaaaaaacaugaaugauaacuggucccuuucugggugguuucacuccagcugaagagauaagauguuuaugcagguuguuguuauaggcaaaagcuagugacuacaaggagggcauagaaggugguucugguaggagacggaugggagaggacgggaguggaacuguguugaaugaaggcugugucuuccagagaacagucaucccaggugcaguucuccucagccuacaaacugccgcauggaucugucccacuuccuguaacacaauaaauaucuuguggcuuaaaauaauacuuuauugcccaaaaauggaaauguuuccauucccaaauguaaugauucuuuuuaaguucaaguaguccauaaaguuaaaguuagaccugggauaacgcugcgggccaugacaugagcagaugguuuccugccuccccacccccaguuaaguguggccugcccuucccugcuccuccuccucgugugucugugaacaguuuauaucagcuaccagaaugccuccugccaauggcuaugcuagacaugaugaguacaguaucuauuugggaagcaaauucuuuugaaggguagaaggcagaaaaguacacaggucauaaguuuacaguauaaugaacuuuuuagaagcaaacccacucauaaugaagauccagggccaggcacaguggcacaugaaggcaaaggcaggcagaucucugugaguuccaggacagccuagucugcguaccaaguuucaagacauguagggcuacacagagagacccugucucaaucaacuaaugaucaaaauccuaccagggauugugaaggaacaugcucgcugccuaaacugccuuccucaccuccuucagacuguucuuuucuaucuuuauuuguaaccuuuaucaauaugcugagauuuuucuaaauuugcccuuuuguucugaucaccuuucugaaaauaacguuuacauuauuuguaaaauacauuauaggacccuugagugagguugagacaaguguagugacucuccaugauugaaaugaagccaagauccgggcauggccugcgugguaggucaccuuuucaggagaugcccucauuccuccagaacaggcauugaggccgauuaaaggagaaguauaugccuuuuucugaaauggcggcuaugcagaaagauggauacauggcuagaaucugcccucugcuggacacucaugguacaacugggagaagguacucuccuaaggcuuccuggauggccagccuuucacccuaccucccuccagcuguucuugcaacuucucuuuucucuuacgcuguuucacaacaaugauagaaaauucagcuuagcaaggugugaggcaaaguauguggcaaggccuuuguaaauguccuggcaguuuacugugaauguggaguaugcugggacugcucaccauuccaaucucacccacaagcaaugaaugagauuggguccugagcuagcgucaggagaggaggaguaaccagcuguugugucucuccaggacucgacaaggagaacguugaacucucccccaccgcuggccacuguaacaguggacggacucgccauggauccgcaagccaagugcagaagcaaagaagugcuggcaguuucaaacguaauagcauuaagaagaucgugugaagcguucuuuguuucacucuucaaaccaaccuaacauggcuucucacuagugaccccucaccuugcacugcugcacuucgugucuuaugaucccaucuggucgccgugucgccagacggucaucucuuggagcauugccuaaguuuaaugcugcuuuucuuugauguuuuuccuucuacuuuggcaugugucugguugagcacuuguucugaggacagcagagacagcaggcggucaggaggccugacugagagcguggaccguggguguggaugaacccugcagugcugccgcugccgcaagccacgggccguacgcggaggacggccuucuguguucccgucuugcagagugaaggggucgucuuaguuacacacuuauaaguuugggggagaaaucauauuuuaaccccaguguauuuaaucuucuagcuguggacuuuuuuuuuuuuuuuuuuuuaccuuauguaguugaaggaaccacagaggccaagccucaauaaagccacaggccagggacugagggaggggcaaacuaauauuuuguaacgaauucuuaagaaauacuaacauuugagucuuagcaauaaguacaggaaaauaagcgugacacacacaucuuaacauugcugaauuaaagcuauugguucugaggccuuauacauacuuggucauccaaccuggguaauuuuuuuccaguugauuaucuuuuaauuuuuacauaugaagguguucuguucuuuuuuuuuuuuuuuaagccaagacuauacuaaguauagaaacuacacuuguguuugcacuugcuuucuccucuuuccuaagugauucuaagcaggguaauuugcagacagaguggugagacucguuuccacaagguaauuuucauagcucuuuccauuggcuccguagcaaaauggaaugguacgugacauaggguaggugauauuuuuauuuuguuaaauaauuuuccaagaaacagaauaugcuguauauuaucauaaauuucuuugauaagauguauuuuuaaaaucuuuuaaucuuacuccucuccuccaaauaaaaucaggaaucucuagcaaaacauuuggauucuaucugauaggauugcauuuagucacugugaagucuggccggccugugugguauggacacaggaccucuaggaucgcugcugugcagaguggcuggaccagugggacucaggcccuuccaagggaugcacacccagcugcuucaugguacccgcaggaugcaagacaguuugacuuuagugagcacaguaguacauggaugcucucaguuaagauugaacuauauuuauuuuuaaaagguauuaucccucuacuuccagguucccuucauguauuaagacauaauggcuuugggagggaccaaaagaaacccaguaggguguggacagguccuguagugcuggcucacuaguggauuucaguaaguuaaacuccacagcuaagucaauaaauaaugguacauuuaaguauucugacuuuaauaauauaacacguuucacacuuauccauacaguaacaauguaauauguuaauguaaauaaaauugcuuuugauauucagaaauaacaauuuaauuuuuuuaauuuguuuacagcccugggaaaaguaagaaccauuugccaaaauaaaaggaaaccccuuaguguuaguagugauuuuaacauagaaucacuggagacuacuggagacagaugcagcaaacugagcucuuguaaaggcugccuuagaauaacugucagagcagauaaccaaggcugggaggcugagaugccagcugaguuuagccgcaggaggcccguggcuuagcugccaggcccggcuccccaccgcaguacugcuggggugcaccccgcucuggcuccugcaaccgugggcagcacagacugaggcugcuguaacucuaguugcuuggcuuuuuuaaagucauugaguuccauuacuggcccauuacuguuuugcuucccccaucaaaacaggacaacuuauaaaugugcacucuuccuguagcggguuuccccauaguucuuaaacugccccacuugagcuccuauggaaagaucaaacggagccacuucugaccaguacaucccaggaaacuggggcagcauuccaguuuuaucuaauagacagaacuuccagcuuuugaggaaagucuaucuuugcaagcaacugaaccuacagagcuuaaaguaucacuagcugccccucccccaaaggagacucuaauuacaggagcagcugaaggucugaguaaugucccauuuuacacaauuuggugugaguucugugauucauuuucaauuuguguuucccugacuuaaaagaaaacaaaaaaacacuaacggcuguguuugugcguuuggcugguacuccuccccugggcucccaugcccucacuguggggacacugcacucugcuggacaguuacucuugccugcauagugcugaggccggagccuggacagugcagacugccacagccccaguggggggacucgccccagcaaccacuuccuugggggguuuaagguugcaaguuuccucugggagaucuggcuuuuguuuuccagguuuggaggaguuucccccccccccuuuuuuuuucuacauuacuccccaagcauauugaagcaugucuuauucaauguuaugcaauggacuuccacaaaaauucacuuagugucagccacacaauuuuuuuuuaaugcgguauauuccccuguaaauaguuuguguaaaauuugacagaaaagucuauuuacuacauuguaaauacaugugaugauauauuguauuauuuugcuuuuuuguaaagcaguuaguugcuguacauggauaacaaacaaaaauuugauuauucuuguguucguauuguuaacuucuuccugcgacugcguuccaucauuuaaagaaaaugcuguguauugugaacugaccuuguauaugauuaacuuacuccccuccccaaccagggguucccugccuacaaccuuguugauaauguaaccagcaggagaaccucugccugacacacagacuccacugcuguggggaaacauguugacgucugucgcagagcaucggccucacuugcuccuguccuguguaugcccucccucccacccacccccccacccacccccuuuuuuuuuuaaaguaaaauguaaauucaaucugcucu

SEQ ID NO: 12484 - RNA, 18874 nt, Mus musculus
agagcgaguggagccuccgccagcuccggcgggcagcgggcgcuggagcgcagcgcagcgcagcucagcucagcgcgcagcaccaucgguccgcagagcggacugagcuagaagcugagcgcugucgccggaggcgagcaaugaggagggcaggugcugccugcagcgccauggaccggcugcgccugcugcugcugcugcugcugcuucuagggguaagugauuaguaggagggaccuccguuaaccuuuucaaagagcugaaccccaaggggaugugggugccaccacccagggaacagaauaagacguuaaggucccagaugcuggcaacggguggcggaggagcugcgggaucaugacccacaggggcgcuccuagcuucuaggacuuucagagcgcagaggcgacccagucccaggauagagaugcagacaggacuguugcaacgacacccguucuugguucugcuugcugcugcugguucuugagcacuacgacgggugcgguguaggagacugggagcagucucgagugggguggagggagguuugggaaucucgggcgccuggguucuuuugacgacagcgugugaauuuugggaucccgaggggaguuuucucuuuagcaucuuagucccuggggaguuguagggcagagagaaggaagggaaagagaucggcacuaaagaugugaggggcuagagacggaacaaugcgggaggcagcuggagggacuggaggcagaggggacccaguauggacaauggggaccggccagacaaugggggggaggggcaucgaaaggagcgauucgggaguggcagagagguugaagagagagaagugggcuuuauggagggcagaaaagagacaaccacaaaagagauagagaaauggaaagaaggugcauacccuaaagugcucggggccccgccugucugucuacucaaggacgaugcgaugaggacagcccagucacagacguuucccgcguggguucuagcgcucuuucuagcggccucgcccaguccgggaauugcgucugggcaucccaggcagggaagagagcgcucacuucacuauggcaaauccgcuucuaggguaguuccuugacaaaccuuucacgugguuugaagcaacucaguggacccggagagacagagccggggcaucccccuacccuauuaaacgccggccagcucucgagaugcggagcgcugggacucucaaggcugugaugguuccggcagcgcacagcuaggggaugcaaaaccccaggcgacccgcagggggcacugcgggcgagggauugcuguugggagcugcgugcgcgccuugggcugcgcacugagucccuucuaaguuaagccgccacgggcccugagcccuccgugcuccuuccgguccagaacuuaauaggaucaucaucccgcccacaccuggccaggcuuucggugaaagucaaugaacgcuucucaaaugagacaggggccacuuggaugccugggauucuugucggauugcuguucggagacaccaacuccggcuaaggucauuagguccuccuucuaugaaccugaguacucuggguauuucugaccagaucuuaaggaagguuggcaaugaaagugacguccucuccucacucuucccuccacccuuuccacauccgagcacuguacaccccccccccccaucuccaucuuacugauaaggaggcagggacuucgaaguuuaagcaaguuggucacgaucucaagccagagucguguggcuggauggucaccucguuccagcucugaacucccugggcgcgcgcagguggggagggggcggcagcugguucgcuucguuucacaguagggauaugggugacaccauuccaaaggauaggcaggaggugagauauggaggcaagcggauggaaaacccuucucaagcccaaacaugguucccuggagcugucaguccuuguggcguccuccggggacuugggagugacugcaagaguguuugcuaacuaacgcuucugguuagaggugcuucuugguccuuguuaugguuggcuagggaagagggccuggggcgcugcguaguucugauccuggaggggugagggcguggccacugaaccuugacagaaccuuuggacuugagccccuauggcucuguuuuccaucucugcuuuccccagguuauucaguuagagccgguucuguguuccgccgcggaccgagccucuuccugcgccgcugcgagaguucugaaaccagagcgcaaccagagucugcuggccggccgcgccgguaauggaggcacuuugucauucagacgucuguaaccggagccgcccggcuggcuaaugcuccuaauagggaugcagcagcguaggcaacaaaugggcagcaugagcgucggggcugcugcggagggugggugggugaugaagcggcugcgggaagggaaagccuccacccuaccuggucagcccagucugcauguagcaccuggcuccucccuagagggaugaguuagaagggaggacacacuaaaaucugugaaguaccuacugugugaccugcacuguguuagguacuuugacguuauauacaccacaggucccagcaacguaaauuuagugauugccaucuuacagucgaggaagcuuaucccccaggaaauugaggcagggcaucaggcuccccaacuuagaaagcagagggggcauguuggaagccgggggucauugacuuaguuuuuccuucucacgcgcgguuccuuucagcuucccaccaacuuagagaucacucgaggggguguggucccaaacugccucuggcuggguaaauuagccgcugccuuguggcucugaaccuagccacuccccuguucuaugugugcagagcccuagccuaucuucaaguccgcauaaggcagcuuccuuaaggaguuaacaccagucucuguacucaugacucaguggcuuuccaaaggggcgaggaguggggcaguaaucaaugccuaguccuggcugaagcucuccagauauuggaaaaccccuaucccauaugguugugaccaggcucuauucucugaggagccuucucugaagcuguuaugaauggucaggacugaaaccauggaagcauccauaugguugcaaacccugguguguguguguguuuucuguuuuauccaauugaaaaaaaaaaagccaauucauccaagcacugacagccagcccugcaaugacauaaauagaucguaaacauuuugaaaaauggagaagucaugcuaucaacuuugaaaugaauaaaugcaguagauauaacuacaggcaaaugggucugucacuuugauaaauugaucaauuuggaucggaguuuggagcaauuagucugaacucuagucacacgcuccugcuuggcugccgccuuccuuucugccuugucuuccuugggcagcagcucauacuuccuaaaacaagcuacuuccucaccaacuaccauugauugaacuccugcuacacucuacccagacggaucugcacacgauuccauucaguucucacggcaacccaguguaggagccacgcuaaguguuuuagaugggagaacugggauucgggaagaauaagaugcucaacaucacagacugcuuaguggcaaaucuaggauuuuaugacagagggaacauuaaccaaguacagaugugaauacugauuauguggccucaacucuaaagaaggggggaagccuaaggagaggggaggagagggaaggauugaagagaaaggaggaguggggaagggaggggaggagugggaaggaaagggggagaagagaggaggaguggggaagaguggggaggagugggaaggaaagggggaggagcagggaggagagaggagggauggggaggaguguggaggggaaggaaggagugggaaagaaugauaggggaggagcagggaggagagaggaggaguggggaggagugggagugaacagguucuuggcagaggugcuugcccaaagcuauuacgucucugacaaggaucauacagccccuggcggucccucaaugcacacccuccaacucucugcugaccuugguuaagaggagugguggugcacaccccagauccacaaagggaacaacacacaguggggggcagaaaagaaagguuauaaagugcaccgagcccauccucacacacucauuuacaagcagcaggcugaggcaggcgcugccaugccuaccuacuggucgagaaauuaaaaaccggccugucacucuggcccucagugaugagggacugaguagugauuacgccaaguguuugacucugggcacuucuucccuccauguaagcuucuacucagucaugccuccaucugucugucugacuguuugucugucugucugucucucccucaucucuacuucucuuuguguaguccuggcuggccuugaacucagauccuucuugcuugaccucccuuaugcugggaucacaggcaugugugcaccuggcucccagccagcuuuuuacccgguccgguggcaucauuuuuuaaagauuccauuagagcugacacuuuaugguucugggagagggacucuuccggucauacugcgauaggagcaagaagugacaacugauacccugacaggaagagaagggacaggaaaacuaucaaaaagcugacaaaaugacaaaaauguguucaucugggauggaagacaugagaacacugcggcacugcaguccugggucaucguuggugcuaacagucgaugccccugugauggagaagcugcagagguggaggagggcgaugcccacccugcaguuuccacccccaacccugccaccuccccucucaguggaggagaaauguacugggggacaauaguauacuuuugccccugaggacacauagccauccagagugagucuuccagguaacugaaggcacauggcaguuuccuguucuuaaauuaacaaauauguacacuugcucccuacuaugugccagagagggcaggagauaccaggacaaccucaguccauagcccugccagucuacucugggagggguaagggugauaggaacacuuucuugaggaaguaauauuuaagccgagcucuaugugaugaaaggaaaucagaacagacccuucugaaaucucagcuccugggagaagccugccucaaguaccucagggcuccuggucugcagauguugccauugccagccagcacucccacugccagcaccugggaggagaugguggcagcuuccggugcugccuggacucucucugcugcccuuauggagaccacucugccccuagggcaucacccaguguuuucuccugccucuguuuacuuuucugucaaacucuggugaaaccacagugguguguguguguguguguguguguguguguguguggugugucuuggcaaagaucgguccagcauggaagcaggagaggaaugcccaaacaaucuuguaaagcucucuggucucacgaccaaagcccaaauugcucagcaucaaaugggguggguggggggugugugcgcaaggucuggagccugcagagaaggcuuuggaguuuuauuagacauuaagauuguucuuuaaggaacagaaacaaagugagccuccaacagccccucccucgggggaaucuggugcuaagucguuccauccaugagcaaagaugcuuuaguggcaggaaucugacuccccccccccccauccagcucuguucccaggggccacaugggaggagaggggaggggauggagucaggcuaggacggggaagucaacucuggaagaauagaguugcuggcuggugaaagccggccacugauaacaggcgucccuuucucugucuuggcuccagacuugcccaucagucuuugcccuggcaccaagcugucccuguguuuaucugcagaggggugaaaacucccaaaggaaacccagggcaggccagacaccuccaguacagagucaauauuugaacccaaguccucacugccuucuguucuuggacauagacaacuccguuuugauauuuaauauguggaaugagaccuggagaagggcccuguucuccuuuuuaggaaagggcccugccucuggguaacugcagcccugcaggugugaaguuuagcaaauggaguuugggccaaauuucaguuccacuggcccccuuggcuaggagcccugugcaagcugcaaccugcccagccauucuggauaucggucucacccuccuccugugguguauccucaggacuccaggagaggcuguaacccuaaggugaacucugcagaagguuagccacugaggcuaugaccucacaccccagcagcagucaagggccccacuccccccacgccccccacugccccccagccuuccuuccugccagcuuugauccuccuaaugccucccgggugagcucaucccagcccaggugguucuaauagaaaguauuaagagggaggcguuugaucccuuggaagacaccaccuuugcuccugccaggcugaccuugugaucuccuuccaccuagguguccuuuggaggugccaaggagacauguuccacaggcauguacacccacaguggagagugcugcaaagccugcaaccugggcgaagguguggcccagccuugcggagccaaccagaccgugugugaacccugccuggacagugagucucuuaggguggcaaaaggggaagguuuagcaugcacagagcagagcuugaaaggguuuugccuccuggcagguucccugccaaccucuguacagguaccagaaaugggugggauacaaagcaggaggagcagggagggacugaauggauaagggaguaugcugagggaggaagggauccagugggggauccccagaggggucccccuucccagcccccucaagcagagaggcugguagaagaguaaagcuaggcagggagaaggaacugaugcucaggccagcuaaaaauaccuucggugcugcaagaucaaugguugcaaccuacccucuguggcuuuggggggaggggaaaaagaaucaaauccuggcugcccuggaaacugaccuugggggauccugggaggguguggcugccucuccuccaggccacuguucuguagcuuucugaugucaagagggacaggggcuguggcacaaggauguccuuacuaugggauggcauggaguggaaacugcagaguggagcugccuggcauuucagaaauagagaggcucaucuuccagcagugguggagggagaggccagaugacagcucuguucucauccccgugugaguucugugcccugugggaccaggagucucaguuucuuccgaggcugccucaggccccaaggcagaagaacucuuucccugucugcugccaggaagaugcuacaucuuccaggcauguaguccccuuaggagggcugcugguaacagaauaaggagcugggaacucugagccuaccagccaguccucucuuaccucuguaugcucccucccgagucugcccagccuucagguaaccggacuccuuaguguucucacacacaugcauuucuaucucugugcuugugacuucuguagcccuguccccagcagugggacaccugggcuggauggaaaggcucugcccucuuggaagguggcaccuuaccuaccucagauucacagagucucuguccuaaggcacugaacaucagccaggaguacugccuccuauugccuggcugucaguguccuaggucauaccccucucucuccuguguacccuucuucaacagcugguggguuggggacucaaggaaagccaugccaggaauuaggaaacacgccaggagccaggggcaacucugagaggggcggggcagccucccugcaucucuccuucccccuuuccucuuccuuggguuuccucugccacacuccccuccagcuguguuaacaggcugcuuuuacaagccuacuuuaugggcuggggaccccagcggacuuucccuccauccucaaaaaaacaaacccguuuccacuaggaagccuguuaagcuccugccuucaugcucugccaacaaaagaccacaguuuucacaccauccacaaccugcucccaggagucauccggcucagcucuguguuuucccaggagccggcuugcucuuuccauccuguccccacccucacucccacacagcacccucucauuuggagagauuguccugccaagugcuuucugccauccgacugugccucaaccaccaacgaucuuuacuaccguucaucauggggucuaucacauucuucaucacaacccugugggugugggugugggugugacuuauuuaguuuuuuuuuuguuguuguuuguuuguuuguuuuggguggugguacacccuuuaaucccagcacuucggaggcaggugucaggagcuagugagucacagaagugaguuggaagucagaucugccugauaccagggaaagggaagcaaguuaccucuguaagaacuaccuggaaguggaccuguuacccaggccccuccccuucuguuuucucuccuguccccacugcgaccccuuucauucuguccuuugcuuccacccaacacacacucucccuuuagacgguaugcuugagaacugacccuuaauacugaaagggccagggcacugugccugcaagugucucccgucuuucuugcuguaccugcgcugucuucccuggagcacuggucugcucuuuagagccauacaugcccuuggacaggcagcaugguaaggugcaggcaguaugguauagcagugugccauucuguugucccuccauuccaggcuuacaugagcugcccucucccacccccugggaagagggccaaaaaggacaacucaggcacaggcucaccucuggccagugugugaggcuggacggaaccauucauauuauauuuuaguugugcugggaacuaggguacagguccgggaacucucugagaacaaggaauuuaccuaaacagcugggaccucaggaugccccagggccgacucuucugggaccuggggaaugggucuccuucccagucagaugccaaaccagcuuucucaggcugagggugagggacuccagcaaagagagugucaauaagaaggugaagcugagacagaggcagcaguccuagcugaggauggggacagagggauuccaguccuguauucacaugcccgugcucaaacaccguccuugugacuaaguucugccgcugaugcuuccccguguguguguuguuguccgcagguguuacguucucugacguggugagcgccaccgagccgugcaagccgugcaccgagugccugggccugcagaguauguccgcucccuguguggaggcagacgaugccgugugccgaugcuccuauggcuacuaccaggacgaggagacuggccgcugcgaggcuugcagcgugugcggggugggcucaggacucguguucuccugccaggacaaacagaacacagugugugaagagugcccagagggcacauacucagaugaagccaaccacguggacccgugccuacccugcacggugugcgaggacacugagcgccaguuacgcgagugcacgcccugggcugacgccgaaugcgagggugagcaugguuccaggcuggguggggugggcgugaagagcuagauucgugaggaagggcgcccucuggaggucguaagggccuaggcuggccuucauccgguaagaaccuacuuugaggcuuaguaacacauucuugauaagagcacugagguggugauucuagauucaaccucgcagcaaaaucuuuuccaccaauuccuucuuuggacugacagugggaagacccggcuuacuguucacuggaagaagucauucuaacuccucucucagcgauuauaugggugacaaacagcaucuggaaggcgccauagaugccagagucugaaucaggcuuccuuccagccuagagcaggcuuucugcucuggagucaggcuggggacucacaggagugaggggccuucagcuaugaggccagauguggguggugaugauggcuauagcaucccaaaucaaauuagccccgagugacaccaggggauuacucccgucucuggaccuaaguguuuucugguagccguagggucacgauaaggcuguuggggugagugacacauucuccucgcggugucuggagaugagguagcauuguggccauuuaaugagacagaguugguugaaaaaaaauggccagauaaugaaggaagugguuccagggaacaaaagagguguggcaagugggggcauggcaaguacgauaaugugggccaugcuuggagggcucuccucuacugagggcuguagacaagagaaagcugugggccugccuuauccagauaacucaccugaaagagauagagagauccugggacaggaggaggcagcugagagccaggguauaggcaccacggucacugguaguguucuucuccaaggggucaacugguauugguuuguugcuuguuuguuuguuuucauucuguucaucagcggguggccugcccauggaucuauuugucuuugaauuugaaccucagguugcccucacauugagcaggcaagagcauccccuucagggacgucccuaguuuucccggagagggaauggccuuugacacagguccaaugagaggagcaugguaccccagcccguggugaccuggagagagaagacagccgcagcuuuggagauucccgauccugauggaggcaacacaguuucugccuuccauuggccucuuguggaauagaagcuacagaugcccuguccuugggccggggagggguccugacaaccagccagggccuccuccauacccagacuugagcuugcucuaguaguagagcagagaagccuggcaagcuacacagaggcccuaaacaugcuugcaguucuuugaugaauagguggagagggauggggcagaggccccaggguggcugugguggagauuuccacgggucaagacaggcaaauggccucagaggcuaagcugagcggggagagagcuucggcagucaggcagcaggaagcaggaagcucaguucugugggcaagucuagaucagccgguggugcacaaggucgggguugugauuagaggagagggaggaccugguuggaaaaggggcaggcuccgucuugcaaggaaucauuucuucccagacgcgauccuucuuucucagucaucuuggcagaaggcacccccugaccccccaguaacauuuauccuuauauuguucuuucuguuccaacgucugaaggguuaaauguuggcccugaggccaaacaucccuuucaggaaauggaauuugauucuuggguuggcagcccacucuuguccaauguuaaauacucgcccgcauauacauuucaggugucaacauggugacucacccagccuuggggcagacgcccggccuccuuaccgcauugaaguuuaggaggggucaccugcucccucuucuuccugauagcucccauuccggaaauggcugucaggaccugccaaguguuuagcggguuggaacgucagaggacaggcccacaucuggaucucgucuccaacccuaucagagaggcugggggcgggggugaggggagguguccuggacacucgacacugccuuuagcccuucucugaggcuccuucauuucuguaucgcucacccacccacaucaaccucgggggcaggacugucaaucuaaacugagucacaucugcaaccucuggauucaggcuacaccuucaaccuucccuguuccccuagcggaucauaagaagguccucuagggucuaaugcccagacagggcugucucucccacuucccacccucuccuuccagcccugcccgguacugggauggggguggggugggacugggcagcagauggcaaccuuccccacacugccagucaaauggauuccagacucacaucugggguccuuaccccucagaaggugcugaaaauggggccuuugaagcaucucugucccgagccagggagacccagaggacuagugggcagcuuuaacuccagcuugggugggcacacuguagacugggcggggcagagcuggguagcaaaguguccuccccuuaaccuuacaagcauacccugucugcuuucccucccuguuuucccugcgugggaagugagaauggauaggacaggcugcuuugcccagacaaguaucccccaggccaccauccagagccuacaaccccuagcccugccucuggcuggguggcagaauggaaaaucccacccacuagugccaagaggggcuggagccucugccaggaaggcuggcaauguccaaauggcaugagcgggccuagauggguggccaagcacagaauugcuccuucugaggcagggucuaguucguaggcccucccuccgccagcugucugcuuccugcuaacgagggugccagcugucuaacccacucuucucuagaugccagggcuaggcuguuuugggaguggggggugucaggcguuacaagaaacaugcuggccacuguucaaggacuggcugggggugaaguaagccaguuauacaucuagugccagccuaggccuggagcaucugagacaggaaggggcugagugccaccugccgggcagcaucucugaucaggccucugaucagcucuaagugcccuauccuuccugaaggcuguggucacuaagucagagcaauuccauuccucaaagcaauuaagucauugcuccagcuuaaagaugcucuacagcaugcaggcuucuugguguucaugcguggcugcuggcagacacuagaauccugguucugcagccuaagccaaaaaguuguuuaaagaccauuucuuuucagaaagcccauucucuagauggggaagucgaggccccauacugauagaagucuccugucauacagcucuugcucuucuuuucuaaacugcaugugcacagucccagcuuccacccccaugcguaacagccuggcccugugugccuggaggcucaugaugaagcccuggaaagcuggagcuaaggggaaggccuggguagguccuaacuccuguggcccuguuccucagagaucccuggccgauggaucacaaggucuacgcccccggagggcucugacgucacaacacccagcacccaggagccggaggcaccuccagagcgagaccucauagccagcacaguggccgauacggugaccacugugaugggcagcucccagccuguagugacccgaggcaccgcugacaaccucauuccugucuauugcuccaucuuggcugcugugguugugggccuuguggccuauauugcuuucaagagguaagagggggcacacugaggaugacauaggagauguuugcuccgaccuugaccuggaaacauacauacccuuaauucaacccuaaauucauccuccaacacuaucucaugcccucugggguguauccguguguguaugugugugugugcucauauuaguguguguguauguguguaugguguguguauguguguauggugugugugugcucauauaguguguguguauguguguauggugugugugugcucauauaguguguguguauguguaugguguguguguguauguauguguguauguguaugguguguguguguguguauauaugugguaugugagagugucuauguggugugugugugguguaugugcuugcauaauguguguguaugugugguauauguguggugugcauguguauaguguaugagugugugugugugugguguguguguguguguguguguguguggugugugugugguguguccaugugguguaugugguguguguguuugugugugugugugugugugugugugguguaugagugugugugguguguuuguauauaguaugugaguauauguguguguguauauauauauauauauauauauacauauauauacauauacacauauauauacacacacacacacauauggggggugagugugugugguguguaugugugugguaugugugggaguaucugugugugcgugugguauguguguuugugugcguguguauguguacaguauguggggaaguguguaugggagugugugugguguguaugugugggaguguauguguguuauuacaugguuuucuuuucuguccuggcuccagcucuucccuacucccaagcugcuccuccuguuccuuagucccugccaccuccucuggcuacuugcaucccugcccucagucacacucaccccacgguuccugguucugcaugugucucuucucuuccuaagucacccuugcuuuccugucacucccaaacucccuuguuacccuugggcuccugugggacccacaucaaggaauucaagacagaagaacucgcagaaggcauuuucagcuuugagugugcgucccauuccguuuuucuuuucuucuuucuuucuuuucuuuuccuuugguauuuuguuuuuaaaucaucaaagugauccaugcuuuuuaaaagcaaaugcaaacaagacugaauuuguuuugcggugcugaggaauggaacccagaucuuugaacaugccaagccugcuuacuaccacugagcaauagcuccagucccaagacuucuaaacagcuuccaacgcaaaaagcaaaagccucgcuuuaucuccucaaauccugcacaucuugugggaaaucucuuugggauaacacuuucuaagcuguuuagagugcauauauauacacacacacauacauacacacacacguuauaugcauauauacauacacauauacccacacaugaauguuuuauaauuacauguagacaugaagaacuuuucugacgauucggugggaacacaccauucaccgucuacaauguacucuucccucuuacucccccucaggagagcuuuccucagaacacagauuaucugaucauuuacagccucucauucaacagcaccagacaugggcuguaaugugcuuagccaguccgcucuugauggacacuuaucuucagaguuuuuguugcugcugcugcuuauguuugccaaggaaaucuguguguguguaugcgcauguguguguguguguguguguguguaagugagugugugauugcugcucacauaugggaguauuuuaguagggagaaauggaauuucuaggaagucauuuauuuguguaguugguucugugaacauuuacugaauguuuaccaaguuccuccacccuugcagagcuuucagaguguguguguguguguguguguguguguguguguguguguguguuuaugcacccgcacgaguguaccuacgcacccaccugcagaaaugagcaucuuaucgccucucagccuuuuggauaagaucauauacagaaauaagcuccuuagacccuuuggggacauugccacacucccagccucagucggcagcacagcuacguuggcugcacugauagaauccucaccccaagcccuggccuauccccugucccugggcugcagauggaacagcugcaagcaaaauaaacaaggagccaacagccggccggugaaccagacacccccaccagagggagagaaacugcacagcgacagcggcaucucuguggacagccagagccugcacgaccagcagacccacacacagacugccucaggccaaggugagugagaagccaaaagacugagggugcaguuaugauuagacuccaggagggaccggcagguaccaggguaggagaggcuaagucgggugggagacauaggaaaggggaagguuuuuguuuuuuauuuuuguuguuguuuugcauuuuuuguuuuuucuccugggaugacuugggaaaugcaggcuuuuauaaguuggagcauccagacucaucaggcuaauugccccccccugccccgggggguuaauuacugcccaaaguggcugcaauuagccuccugcccuggacuucuaggaaacaagugcuuaaguguguaccuuaauuagcggcccagagccaggcucuaggacacuugcugcaguugucuggagcuggauugcccuguccccucccccuucgccuugaugauugcuggggggaggggacacgcguggaaaggauggugccagcaccgaggguguagggagaacagugagucagcaggacccaggucccucccacccaggccucaucuaggaccucaucuuggcuaucucuccgccucuaacucuagacuuggaggaacgugccuuggcccuucuggggucuuggcccaagcuucuaggcucacggaaggaaccagggcucaggguuagagaacacggaagugagggcucaggguuagggaacauggaaggagagagggcucagguuaggaacugacaccccuuguucucugcagcccucaagggugauggcaaccucuacaguagccugccccugaccaagcgugaggaggucgagaagcugcucaauggugacaccuggcgacaucuggcaggcgagcugggcuaccagccggagcauauagacuccuuuacccacgaggccugcccaguccgagcccugcuggccagcuggggugcccaggacagcgcgacgcucgaugcccuuuuagccgcccugcgacgcauccagagagcugacauuguggagagccugugcagcgaguccacugccacguccccugugugagcucaccgacugggagccccuguccugucccacauuccgaccgcugauguucuagcccccacagagccgccccccucucccuugggguggcccaacagucagaaccgagcaucucuguguagggccucugugucccgcuccccaaaccacagcccuguugcugcuccugaggggaccuuugcuucugaccacacucucucuccggcgagagauaggaccaccccaagccugucuugccccgugaccaucucaggccuuuccuuucuuucuacacauuaacugugucagaucuaggggucugacacuagagaagguaacaggggcaccccuaagacucaggggguacuaaugaaccagagccauggacuccacacugugaacuggagaacagggggggcauugugguaggccagaccuuccucaaccccucccuucucccaucuggccaaagaugaagaggauuacaggccuaucugagcugaaagcagguuuggagcccaguccacacuccuucucuuacacauaggaugguaaagcccagagaggcagggacuaaccuaggccacccaacaacagggagaucaauuguaggcugacacacuccuuucugaaugagggcgucaagugcuuguuggcagggauggagugacuuucagggaaacaucuggaaacgacgucugccccgcccucaaccacuuccaggccccuacccaacccuugugcagaugaacugucuguucaaaaccugguccauuggccuguucugauggagucgggcuaauguccuggggaguggggugcugccuuccucugucugucaggcuuagccacagggcauuuguggagggaugaaucuguuagcacccucauucgugucauaagccugaagccaacaguggcccuuggagucaacccuaggggucagggaccaaggacccaccccauaauccaacaccacacacacacacacacacacacacacacacagagagagagagagagagagagagagagagagagagagagagagaucaugcuuuuccccccauggcucuuuuugggcugagaccagauccugcuggaagucgcuggcugccagagaaagauggaaggggaccgagaugagcuucguggggcugucuuccucaccucccggcucuggcaggccaagaacugcugcaucugagcuggcgugcgugcguccgucccuguccgucggucuccaauggccuguguguggaggaaugcucacaccgcucccucuccuccccuucuugaagcccaacuuuggcugcacccagaaaacagugaagaaaagcaggcugcugugagaacacaagaaaaugcagaugcuggcccgcagucugaggcaacuuucuccucaguuucauggccccugcaaaggaccaauuuccugggcauggccaggaagggacccgagugcucauuggccggcgcuuucaccuggcuccuuggccuguucuguuuugcuugcuguuggaaugagugggcucccccucuauuuagcaugaaggagccccaggcaggguaugcacagacugacugccaucccuccccacccaggguccacccagcccuguaaggagacaaggagccuugugcucggugguauuuuuauggaccucgaucugcaauuaguagaaggaccccaccggcuggcccuccccggacaccugggaagugggacauucuuuguguauuuauuuuccucccccagaagcugggggugggugggugggggaggagcugcaggaccaguuuagcauguguuugguucugggggucucuccagccuuauuuugggucaagauggaaccucuggcccuccagcuggcgacuaugagauccagaccucuucauguucccugacacuuccccuuugcauccuguguaaucauuucuugggcccucccaaaaccuacacauaaaacauacgugaugaccauuaaauagcaaa

SEQ ID NO: 12485 - RNA, 9059 nt, Mus musculus
auuauuuacaaagauuuauuacagcguaggagggguucaggccuagaguaagggaagaaggggaagggaaccaaguugcuggaggacaaggagaaccaggcuccccccacuguguggcccccuaaggacagauaguaagugcauuccuggcaccaaagcacaaacaaaacgcagcaagcagccucugccaguccaucuugcaggcacccagcaggaaugggauacuaagggagggacauguugaggcucugcaaagaaugcgugagaccugagcccugguugaagucuaugagaggguuggggacucaacgcccaccacugguaggggaaggaggagaucucagggcaccuguaggcucucaguaccuccuuuccccagaucuuaggaccugcccugugggucuccugugcccaggggagagaaucuggagagggaggggacuuguggagaauaaaugguuguuuauggccuucugggguuuccagugugggcucucucaccucccuacucccaccggguaaauagaagaaugacuggcagggaaaggcauuggggacucugggcuucagccaaagcaaacagagaccagccuuagucuucuaaaagucagaagccgcagcccuagcaggugaaagacaggguacaaaggaggguggggacagaguggguuucuggggaacacuuccuccugggagauacagggcucugagcuuaugugccaggcucagggggggcugggaugcugagguuccucuccaggcucugaaagacaaauaaagaggacucaaggccaggcuuggcccaugagguucccacccaccuccccagcccacacuccaaagcucaccacuuaguguugcucugccuuccacuugguccucagaguuuccaucucucuggggcucauccagaggaggugggcgcucccagggccccuccagaccccggccacaaguaggcuucugccccacugaaagagagggcauacauacauaggcugagugccccucuggugcucucugauggcuugagguugagcuucugagacauccauugcugcauaacgggcagaacacuggccuggacuucuguccccgugauuguaacuuaguucaugggcacuuuuccaaaggaaauauuauguaagaagaucgguguagauuaccuuagauaauaccuucugggaagcuggguguggaggcuuacacuaaaaaugcagccaucaggaggcugaagcaggaggauugcuuugaauucaaggucauugauuaagauugaggugcacuguuaagauucgggccaaccuggauugcagaaugagauccuauacucucaagaggcccagaacuggucuccagaguuauuccggaauucgggaaauugauguuguuccuugaggguccggucaugugacucagggcccccuucuccuuccugagggagucgcuuucauucaucucccaucuguucucaggugggggugggggcucagaaggagcucacugacaccucacagccagagaugcaagaaggagacccaaggcuuuuuugucugagcccaagagcugaaugggagcgggagacugugugucauucccauaaaaaaaaaaaaaaaaaaacagguccaaaaaguuuaaugugcaccaggcuaaacagaugaagcacagccuuugguggccaggaguggaagacacaaccaugagagggagugaggucauucugccuaguugucuagugcuggggcaucuccuggggauuucuuucuggcucugcagcuuccuguguagguuuuaggcgccuuaucuccaggcugcugcgguuaaaguagaggugcagaccagacuggcucuuaaaucgucaauucuacaucuggacacuagagggcacucucccacccuauccuaggaaggaaaagacauucucagggguccuggagagggcaaaucagccagccuccuucagcacagcagagagcgcaugcuagguucagaaaugcaugaaaggaaauguuaggcuuucucucgaucuaugaaccuccucacaauuggcuuccauggauagacaguuccuuuuugggucuagccucgguuguccugugucucgccuuaguuuuuagaaagggaugaacgguggggaaaaccuaaucaggcgacagguuaaccaagacugaggggugccuggucucagaagcuggccgcagaaggacaucgcaggauccuucuggaagagccaccacaccugacccacgguagcaggaaccacagaccacagccccuucagcuuaccagugccccugcugccuuucaggaccuccgccuggcugucuucuucuucguccuccucuucauccucauccuccucaucauccuccuguggguacccaagcucccgaagcuccccuaacucauccucuuccuccgaggccugguucucacucaaguugcuaauggucugcaggugcugcacagcuggcggaggggacgggggggggggggggacaagggucaaccaagaugaaggagcagcucaugcaugccacugaggcagaggugcugcccuaaggggcccaaguccaauggugaaaggccaccauccacucuacagaggguggacaucaaaccaagguaggagccacaggcguacauuuuuaaucacauuagcucuuaagcuguuccgagaacgcugcccccccccccaagacgggcaccagaaaacuccccugcaccacaggacaccugucugggcaagaccaggccagcacagcaacagcuuagcauucucuggccagggagcuuccauaaccaggugcccaguacuggaaaguguuucccagcagcauuaaccccaggcagaaggugucaggccuauagaccggagccauuuuuccugauauuguucacaaugauccauuuugcuguggccucucugacccagacuguccagcauuagauaccagucugcaccucuuucccaggcuccccgggcaggaacagccugagggcgcagcacucugcgggcccccccaccccccguaaagucccggcugggcaaguggacuguucagaugcagcccucacagucgugacccauaucccuaaucucccagcucccucugcggugacccagaaagcagcaacaccccaccaccaccaccacgaagaccugcucagaugcagccgaggaaaggaacagugugggcggcuucccaaagacgcaaggcggggagggaacaaggacgggcuggggguucuggggauugucaggguuugaaagaacaguacuggguuaaggcuggggugcuggggggacuggggauguagcguuugcagggcccuggguuuuguuccuagcagaagccuggaaucacagcauccagaaaguagaggcaagaagaucaggaauagaaaugcauccucagcaguggaugaaaccuagugaggucuagucuauccugggcuacauaaacaagccccucaaacaaaacuaaagacuagagcagggucagcaaggggccagggacuaucaggauuuuagaguaggugagacacuagggccacugcccccagacuagacucugcaguggccagugguucugggcuacuuaauccaacagcggccccuccccuuugcagcccaggggguaggcuggaaaccucccaugcagugagcagggccaugcacuccugccaacucagggacaggcacagagggugcauugugugugcccaaugccccgcccugcccccagcuuccaaccuaccucuucccgcugccuguggguaagcuacccaggcaauaaaaucucaauaaauugcccugcccuggccuuggggacccggcaaaguuucaccuugagccaacccagagagcucugaccugaccucaaagcacccacacccaccccacugcuccccugaggcuuagugcuguccacccuuccuggagggcucuugaauccugcccuacaaaacucaagcccugccagacacuugcccuuacccagaaagggcuaagcuugccaaauagaaccaucucggugcagaagggccucugggcugggggagagguggcggcaggcagucgggggaggagaguuauuuaguucgugauccaaggugcuggcaggugugugcagugccucugcucccccucucccucccccaccccgugagcuccugcuggcauuacucagugucucgugccucccugggccuucaagaaucuuucccuacaacacugucuccuucuuuuaccucuccauuucuaggaccuuaaaaucccccuaccccaagucuuccuuguuaagauucaagaacccagaagggggggugguggccuuacacgccuuuaaucccagcacuugggaggcagaggcaggcagaucucagaguuugaggccagccuggucuacagagugaguuccuggacagccagggguacacagagaaacccugucucagaaaaaaaaaagagucaagaaccccaguacagccugacuccuucccaccaucccuguguuucucuacucagaugcuauagacacagcccagagaggcuggaguagacagaucuuuggucaacuuuugguacacaagaaauuuccuggcccuaaacuccucccuuagcccacuuccuaaguauacagccaaagccagggagggcugaacugaaaguguagcucagcguuauagugugugcuuaguguguaagacccggcuuccaucccuaacaccuccccugaaaggacaugggaugguggucccccucauauucacccagccuaggauggagaagacgcacauugucuuaagacagacucucauuauguaccuugagucagccucaaacucacugagcacaaccucaaacuucugaccgucccgacucugccuccugaguggaggcuuacaggcgcgucagcacacuugguuaacguggugcugguacugggagccagggucucacgugugcuaugcacacacuccacgccccagucucaaggccaaguucuuguacuccuggguaacacgccacuugucuucaugcccacucuaagcccuucuacacgucccuccgggaaguccuugcccgcugccacucgcuguagcuuccuuccuucauguuccugucuugggagaagaagaacaccaacucuucucugcaguccucccugcuucucuccugugcucccaggcguggcaggaaggcugacaggugcauguguugaccuuggcugcuggaaagccacauuaaacccauccaccuggggaacucucagcacacuauugcugccuuccagccccaggagaagggacaagcccggcaagaaaggccuagguuggggguggggugggguguggcaggccacuggcaccuaguuaggaagaggccuuuggcucacucagugcaccugcucuuccuucaggugugucucccccagcucccuggccagaaaucaagucuccagcuguccuuaaaaccuggcuucacgccgccagccccucugcgcgccccauuucuucaccugucuuuucuggcccguugauucccuaagccuuagcgcugucucuccugcaaacucucccugacccucagaagcaaaggaccccagaggccagggacugaaucacucaguuuucauuucuguaugagacauacucuugcugcauugcccuagcuagccuggcauucacugugcggcccaggcucauguccauagccaucuuccugucucugccuccuaagggcagggguugcaggugugagccaucaagugacuuuguuuugguuuuguuuucagguauucuuguuuugcuuuuugagacgggggacuugcugugcaacucuggcuggccuggcacccucucuauagaccaguuuggccuugaacucaugaaaacgaccugucuccuaaaugcugagcuaacacagagcuuugcaccaccauacugacuuaucuaaaaaucgcuuuaacccaaggcaugucaaucgaaugcucuaccacugagcuacccugugagccuccgaaucuucaucuuauuucacccaucgcccacccaugagaccuggcaauaugagacaggagugauaccuuuuaacccagacagaaaaguggaugcaggagcccagcaugaagaccugcacacuggaguggagccguggggccagaggggaaggcaggcagcaagcauggcccagcagagacaccaucagagucucucaucucaaggcuuacuguccuguggggcuacccagcuccccgcuucaacccuucaaccuacuguuaagacccuagcugcccucucccugccucuggaaaccuaaaaaggaacuauucucccaagucaggcagaaaggguugguggcaguccuucccagcugacaguuccucuuccucccccacgugcagaguuccaggagaccauaagacagauggaggggugggauuaguaccuuucagugaugggggcguauaggcacagggguugggucucuucgacuuuggguggugccccucuccagagguucucuacaggaaagaagcaguugaaacaggcuccccagauacccuucccuuuccgcucccuccagugggacaacugacuuggacagcugacagagcacaggacaccuaggacaacuaggcaaagccccacccccauuagcagaagccugacucagagcaggacccucucuuggucguggacaccccacaucagccccgccccacuaagagagagggugacacuagaacaggaucuuuccgggaaaaugcaguugacaugccaauauguccugugguggccuagguuggcucugcagauaucagucuaccacaccccagagggcccagcuaaguguccuuccagcugccccaggaaacucaccugauguggagaggccuccuccucugagaaaggccaucaggcauacagcaaccaugaucaaggaggaagagaaaaagaauaagguuacuuuccccaaagccucagucucugggacggcaaaagugugcccuucccuccuggugccaacaggugccaagaaaauaaaccaacccagcuguguuggcauuccaggccuccauucuccagccugacccucucucgugggagcacuuagaaaggccccagaauugggguagggagcagggaauggacccuaccuggugaggagugcucugagacccggaaaagcauggcagggguuggucuccggcgccggaucuagagagauggaggaaggaaggacaggauaaaugcccuauaggggcaccucaccaucgcacucagccagcugggagcugggcuuuggaguccucagggagccugagaaucaaaggcagcuagagcucacucggcucaugcaaucgcuuuauuuuacggggauuaaaaguccgggaauuagagagguucagcaaagugcccaaggucacacagcacacuugauccaaaggacuagaaaaaccaucccuggacuccuaguccagagagccacacuccacagcuacuguagaacuuucucuagacaccaaagcuggugucaacuccuacagccagcuuaagcacuccaagggagcuaccuauggcccuacccaccaaaggucagcucaaggacuucaaagcagcuggacucagcugcaaaggaagucugagcccaguaccgcaggcaccccuacccucaccugaagcucgagugggggccuuaacuccagacacugaggggucugcuggggucucuggagguuagagucuuucucaagcuguagaauuuaucacccaguucucaugggaaaaaaaaauguaaaauugcucuccuuggccacccuagcuuggcaaucagaccaacugucaguuaauuagguccccuugacgcuccagggaaauagagagaggaccagguaauugaggcuggagcggcugcugccaaaggcugcuuaggcccaggcuucagcccaccccaaccaagcaccccaagaccaagacaugcuuugcccacuuuuuacugcucucccucuucagagccauuggcaucucagcaacaaguguccuugcuaggucgaggagaacagaccucugccuccgacacucucccucacaccuuuguaggucucccaacccucaaggaagagaugucagcucacucccugggguugcaguuccaggucuugagagcagagaguagucagaauaacguucuggggacaccccaccaccaccaacaacuaggccuauagggugagacuguggcccucuagaccaugagugguugaagugacagccucagacgccagagcuguuuguaucuguccaugggauaccaccagggugauggggucucugcggggaauaaaugacuagccuagcggggcuauauaagagccaaaagggcagucccgagaacugauugauagucuccggacgcucacugcaggaauucucccgcccaagauaggcuuaaagguccggagaaaaguugcuaggagucuccggcgaacuuccaguccuguggggcgccccauugcaguccaggcuggauccaacaugggacgggacggacugugcuggggugggggaauauguguugggggugauacguggauggggcgcggcccccuuaccaucuccaccugucgggggucgagcuggcucgggggcgcgggcacagagaacugaaucuucuugcgguccuugggguccauggcgggcggcugagcguucuuggggugucuggcugagcccugcucggcuguccggagcugcggguggcgcgugcugcgcggaggaggaggaggagcacuguccccgcacccaggaaaaucccgcgcuccacgaggagaacgcgcgacggucgggaggacugaacagcggggcucgccugcagcgccgggcucagcguccccaggucagagcucaggauccccgcgccuuagcugcgcgccaccgguuuggggcgcggggcucuggcugccggccugagcuaucucggcgggcugcccucggccuugcucuaccagcuucugucuaucccccacucugccuucuuccucuccgcgccu

SEQ ID NO: 12486 - RNA, 11385 nt, Mus musculus
ugccccccgccgccugcugggccggccgaggaugcagcgcagcgccucgguggccaggcucgcucugcuccagcgugcuugcuaacuuccccggcuccgucucugccugccggggucgccccgugucccugcgcccuccgggucugguucucuaagcucucugggcgcugccuccgggucccuugcagcccgcucgcgagcccgcgcuccccuccugcgccccacccucguccucgccaugcugcccuucggccucguggccgcccugcugcuggccgcagggccucggccgagccugggcgacgaagccauccacugccccccuugcuccgaggagaagcuggcgcgcugccgcccccccguggguugcgaggaguuggugcgggagccaggcugcgguuguugcgccacuugcgcccugggcuuggggaugcccugcgggguguacaccccacgcuguggcucaggcaugcgcugcuacccuccccgggggguggagaagccccugcguacauugaugcacgggcaaggcgugugcacggagcugucggaaaucgaagccauccaggaaagccugcagaccucugguaagguacaccuaccuucccucggccacauuucccaaacacccuccucccugcaacuuaguucccauucuggcuggccuggaaggcccgucaaugcccccugugaguugaggagaagggagguacguggcagagcuuagaaacagccaagaaugcuggcauuuaaucccagcaccaguugccacuggucgagggaaaccuaccccaccucuucaucucaaaccuccuaaguacuucuuugggaagaggggccuuggccucagugguaagccuggcuccugagguaaguuaaaugaccugauucaguuacauuugucaucuagaguuagaugacugcgaugauaaggugugcgugcguguguguguguguguguguguguguguguguguacaugcacaugugcauacgugugugcaugugucuguggggggugauaaggaugguguguguguacaugcgcaugugcauacgugugugcaagugucugugggggugauaaggauggugugcuugugcacguuugugugauaaggaugguauguguauucgagcgggaggcaguguguguguguguguguguguguguguguguguguguguugggacgguuccuuucuguuccugauccagagccugauccacacacccagucucaggugagaggugugaggagccaggggcugggccuuucacucaucacccuggggugaagugggacauacaauucagaagaaccucugggguaaagaacaugcgacuuggacuucccccaaaggcucagaaagcaaaggaagagaaggcagggcucuuucugccagguuggcacauccagguuucuugcuccuuccuucuggcaggugccaucugaggggguuggagggaaaugcugguugcuggucccgaguugcagaccccuuggguauaugggacugagaagagaggagggcuagacagacagaucuugcauuuauuccuucuccuuuguccacuugucgguggaccuuucuccguuucuucuuggaaccuuucucuuguccgucugcuauuuccugccguaucucucaacuuccaguuucaccaaacagccccgacuucucuuuuucucggucuccuugagccugacuaguuuccuucucuugcucugacuucguuugguuuucugcaguccuuccacuuccaucucagacgcucucgcucuuuugauguccugacagugacuccuucugcguguucugccuuucacugucucccugacucugguuauugucccuccucugacagccaggcucucugaaccaccacagagcuucucucuugccugauauucgaauccuccauuguugcaguccggaugcugggacuugagccccaagcuuccugcucugggucccaggccacuccacuuccucaauccucaacaguuuguuagucugaggaaagcaggaugcagggaaaacaggaaggagauggacuccaggggugccucucugcccuuccugcuccuggggcaaggagagaugggucagcagaaaauauucugggagaaaugccagccuggcaaccagcuuugcuggaggaggaggaggaagaggaggaggaggagggggaagaagaggaggaggagggggaggagggggaggaggagggggaggagggggaggaggagggggaggagggggggggcagugagaccuggagagaggguugcauuuuuaagaugcccacuuugagucuuugcucccuuccagcuggugggcaucuagccccaggugaagauggugaguagucuuuccccucuccccaacuugagcccaagccagaagagcucaacaagagucuucucuucugguugcauaggagcaucccugcuguguggaggaaaaccagauccccuggaucuggaaggccuggcacaguuucugauugcucgguggaugugagguuagccagcuucaagaggugucuaggaauagggugccaauacgucuugucuuggaauucagaucucaagacgcuaauuccccucccacuucuugaccuugucuucuacgagcacaguggacacaacugucugaggaaggcaaauuuggucacaagagggcagaccuuagucacuugguuggcaagcuauggccaaugcuuucuagucaucagaggaguacguccuuguugagcgaggccuggaaccuuugcaucaugggaagaguaccuauagaacuguaccagccuugcaggaucgcuggugaauuacugagcggggcucagcccauaccuuacacugucaguagaacuuugucccuuuuaggucuuuagguuugggaccagaaauaaagggcauuauuuucuuuaauaauaacuaguaaagggcacauaagucuauuguuucuguucuuuccucuuggggcugagcuucagcugacucuuuaggugaguuguccuuugguacagcucucauuauguuuuuuucccuagggguaggcuaucccuucucuuuccagccugccuugcucuccccucugacagguuggcgaucaguacaaccaaggccaccagagguggggaugggcguaugcaucagaagucuacaguuucacaucauggacuuuugaaauccgagaggguguucgauggggaggucaagcuugggacagggaguuccuaaaccaggcucuagguccccccgggacaggguuaaggaacaggcaggcuggguuaauuuuuagucaacauagcaaauauguucccuccuucaguacugggaaucuagucaugucauggaaacugggcuuucccagacauucugugcuuuaggggagagagguggaagaacauggcugccuagaguuuuucuuuaauauugacauagccuaaacuauugguggcucaaguggccaaagacacaucucccuuccucuucuccacguaggcaaccacaguguccuccucugucaagugucucaugguucugagguguuugacauagaguguaucuauaagguucauagaugggcgugguggugaagguggagaugaaggagcugaagcugggacuuuggagaccauaggguaagagagcagaguuggggagagucacaggagaggagagggguuucuuuggcuuugcaaugaucucuugucacauuagaagccagcagcgaggaacaaccaugaggggcacgcaccccuugagcaaaaucucaaagaaacagccugauaucuguccuguauucuccagcuagggucuuggggaugaaggaagagagaggcuuuuuuuuuuuugugggcaguuaggugacccucuggagcauggcugauacuucugagucuggcugucaggauccacucaguucuuagccugggugucuuagagaggggucaggggcuggucuugaaggagaaaucauaggcguggaaaguaggcagugggaacuuugccucuacuggggccagagcuguacacagcuucucccugggggcuccuuguccuucucugcaguggagugaagagcaagacuucugccauggcuggguggcagucugcccagcucuaagcaagaacuagaugggaagaccugcuucacauuggcaacuccaccuucuagacaagcucuuggagaccuagcaagagggcgaagggucugcuccccacccccaccccaccccccacccccagcuccugccucgguguuaucgggacguugguagagggcauuugaagcugaacagugcuaggaaguuaauguuuuuugagaggcucaguguuacaccccucccccaccgaagcucaguaccuagagguggauuccaggaugaguccuuagcccgcuaggugagcacggaugggucggggagaaguuacagauuaaauggagagucaacaaaaccaugaugagagagacccggauauuaggguguccuggcuuggucuguguuucugaccagggcagggucagaguacaugaggggguguagacaggcacaccuggaugagcaugugucuggacaugugauuauucguaaacauuugugauucugcgucuguggguggauguggacuuaaucuaucuuaugacccuaggcgaauaagaagcuguucuuccaagaugguguuuuuuuuuuccccacuaaguguagauucaaaccaggguucucugagaagacuaugcacacucagaggcuggcaggcugcuggugcagcugugcccaguuaaggcccucuucaacauggggccauuuaauucugacaucagcauaagcuauguuucugggcuugcucuguguccuacgcuguuguagguuucagcaagcuauucaguuguucucguuaauggugaccaucuuaaauacccacgaauaagcccuaaggacuccuguuguuggcuucuauucacagaaaugccgcauugggaagccguguuguggucaagucucugggccauauuugucugcgcucuugagagcucauuguauucauagcuuugagacuguaggguggaggggaagguguucucuaucucccgaggcaaccucuuucuuuaaaaacuccuaaaacaaaacuaagaaauaauuugagagcuaggagccagaugugguggcgucugccuauaacccaguacuucgguggcaaagcuaggaggaggggguauuagaggccagucucagcuacauagaaaguucgaggccagccugagcuaugugagacccugucucaaaacaaaagagaaagaaaagagauauuaaggcugggauaguagcuuagagguagaaucuuugccuagccucgaauucuuuacugccgaaaacucuucuuuacggagaagaaccugagacuggcauagccauucuggcugaaaagacaacaaaucagagagaauagauucaugggaauggugugccuaaagucaguccugagauguguuaugugagucccagugaucuccucuauccaguuuagcugacuuucccaugcuuggugcggcucuggggccucccugggacuauccguucaucacauaagcaaaaggcuggugguaucuaucugcucugucuauucuuguucuuuaauuugacacuagcacuucaaucaacacaaaauuuguccauagugaaucaguauggaacuuaacgaaaguuuguuuguuuguuuguuuuguuauguuuuuuuuggaugguuuagaucccuucuugcccggugucccuucguuuaugugccucacuucccuuguccccccaaacuagaagauuaaaacaaaaaccaacuccccagcuuuggcuaggcagagaaauaccauuugacccagaggcagcucugggacuguugccauguauggaggaaccugcucaauccucaggaaaaaaaaaaaaaaaguccugacgcaaaccagauguaaccuccugucugccugccaacaucuggaaugcuggcagggccucugcacuugggcccgcauugagcugccaagucugaggauuucagagguggcucugaugugcuuucgagaagccucccagccucuuucuccagcucagcccugcguucuggcccuggcaagcaagagugagcagcaggucacacugcagggccuucuggauggggcagcucacauagagccugcaagggggggggggagggcuaugcagacggggucugcccuccuaauuugcauuuccagauagcccauugccugcuucugguugacuuccauggacacugaaugggggcucaaguuuaagguugugagacguaaagguagaggcuggagaaaugugugugguuguuuucuuuguucuggggcuacacagggucuuucuuggucucucugucucucucucucucaugcagacacacacacucacagaugcagacagugggagaaccuuuggggccagacuccuugcucauggaaaauaugauuuuagcccuagggauccccggcaggcucagccagaugcugaaaaagcagagaaggagacaggaagagugagcagauggagagggagauggugggaggaguugaacagagagggagaagauccaguagugccccccuuccauugccugccucagaccucccugcagggcccaagggacgcccccccccugccaucugggcaguuacagcuggugauucaucauggugaccuggguggggagaggaacaaaccaaggacuucaagaggaauaugcucccaaagagauccagaggagugggguggagguggggggugcuccuauuccuuacuucucgcccugagacucagcgagacucagccaugccguggagacucccugcggaggaggaaccugggggcucugugcuggaggaggauaaaccucuguucugaugcugaccucugccuuucuuggauggcccuacagacaaggaugagagcgaacaucccaacaacagcuucaaccccugcagugcccaugaucacaggugccugcagaagcauauggccaaaauuagagaucggagcaagaugaagaucguggggacaccucgggaggaaccccguccuguggugagcaccucugacccacagaugugcaugcuuauagauaugucacaaugacuagaccugggcuauguucaccuagcaaacacugacgcucccuguguguaacaggaccucaucgguacccuggaaggaguccucauuucucucugugauuccuuuuguguucugcacaugaguauuggcacagcaaguagacugauaaagcagggcccaagcucccuaguguuucuugguccuuuuuguuugguuaguugguuugguuuuucaagaccaguuucucuguguagcccuggcuguccuggaacucgcucuguagaccaggcuggccaugaauucagagaccggauugccucugccuucucuaguacugggauuaaaggcacacaucaccccagccuguuuuuuguuuuguuuaaugguuauuuauuguaagacaggguuucccuuugcagcccaggcuggccuagaacuuccuaaauauaccaagcuagccuugaacuuggaacaguucuccugcuucugcuuccagagggcaggcguugcagacgugugcccccaccuccugccucuuugggacugccgagugucaaaaccuccuccuggauguccacuguuggugccugagucugaguuucugguuucacuucuugagccccuguccagcacccaggccuugaucuuccugccuuucucaugugcugagcagugugcacuucuguccccagccccaggguuccugccagagcgagcugcaccgggcccuggagcggcuggccgccucacagagccguacccacgaagaccucuucaucauccccauuccaaacugugaccgcaacggcaacuuccaccccaaacaggugggucucccuuccugcugcucugcccuggccucagccuggggaacuccuagcucuccgaaggaugcucccaaagggaagcucuccaaaucugauccaaccauuugggucucgcuaagcucuguucuacucucagcauguucuguccaccucguuccuuuuggagaugagagacagacucagaaaggauccuggccagcccaugucgcagaguggcagagugaauucccagcagaacuugauuuccucccagggcccuuugcagcuucucaggauccccccauugaugguguagacccuguucccugugcuuccccucccccuuuccucaaaguagugcuccccaucucugaccaucuggguugagagaaucccaaguuaugagaugucaaggagaaaauagcccacccuuccgcaguugagcucagacuccccaagugcagucaagaaggaaguagaggcagguuugccggccugagacugucacguggaaagaggggucaggagagaaggcagcagguagcaugucccacucccucacugacugagaccauccagcaugcuggcugguguauacugcaggggcagccuguuccaucucaucucuggcccaucaggagggcggcagguccaggcagggagcuggcguuggaaugccuugugcugaauauggccuggggagccuuguccugcuucuccucuagguuaggggagcauagacaggaauguugcucuugagcuacggacacauccucguagugagcugccaccgaagcagcagaggccuugucaggaggaugacacaacuguccuaggucuggacagggcaagaugaagguguggaguugugugaagguguagaggaauggaggcuccuuagaaccagugccuggccuaucuucagccuucaucccaacacacauuucaugucucauuucuggauaccccucgcccuuaaugaaacaagcaaaacccaaagaccugacuguuggguuuguggaaaaaugaggagaaggcgcaggauaauuaugucccccgccugugucgcaguuuauuucaugacucacgccuuacuggauguauuggaugcacuugauuauugauuaaaguucaacauuuauaccaggauucauuuuuccuguuauaucauguuacauguauuuuuuuuaccccuaauuuuuuuuuaagauuuauuuauuauuauauguaaguacacuguagcugucuucagacacaccagaagagggagucagaucucguuacggaugguugugagccaccaugugguugcugggauuugaacucaggaccuccggaagagcagucaguguucuuaaccgcugagccaucucuccagccccuaccccuaauuuuuauugcaacaaaaacuaugacaccugcugggcugacguggugguggcacacgccuuuagucccagcgccugggaggcagaggcaggugaaucucugugaguucgaggccagccuggucuacaaaacaaguccaggauagccagggcuauacagagaaaccuugccuggaaaaaucaaaaacaaaaccagagucuaugacccuugacccuuucucucaaaacaaauucugcugucuugagccaaccuucauucugacuuugagucuggcuuagaacuagacuuuugugcucugcccacgcccacccucagucuaauucugaccucaauucuucugaccuugacuucugucuuuauucugacuuaagcuugcaacaauccuccugccucugcuuccugaguaucaggguucuaggcauugugccaccacaucuaauccaacugcuucugacuugggcucucaaugucaccuggcuuguguuuuaaccauaucccuaaccuaucuucaucugugguccugaugcugccucugcugucaacuguaaucccaugcuucaagucccagcccagccacaacaagcugaaacaucuccagugaacccagaccuuacaucuaucaguuuaagccuucucagauccugccucuggaagcucuguagaucucuuccuugaacgagucucccuacuccagugagcuccaggaacuggugcucaaaaagagcucuugccuucagcuaucaucuugaaggaacaacugucugaccuggggccuaggcuggaggugguguggacuaccuggucucuuugucugccugggaccugaccucauacccuugucuuggcagugucaccccgcccuggacggacagcguggcaagugcugguguguggaucggaagacaggggugaagcuuccuggggguuuggaacccaagggggagcuggacugccaccagcuggcugacagcuuccaagagugagaccugccagcaggugggggacucagugcccccuacuaggccccuaugcucugggguuguagaguugaccuggcuuggagucugaguccuggcugucugccucuggcccugcccaaaauuucccuuugugugugugugcacacgcgugcacaugcucguguguguguguuuauaggaugugcccuacaggauaagccugagccuucucgugcccaugaugggcuuagauacccccaagaggucugaguguagcaauaggaauucccagugugcuuucaaaucacuauggaauucauucauucauucauucauucauccaccugaaaacacguauugaaaacauacuaugugccagcuuuaguuuucagcgccgggaagccucguugugauuuccuccgauuguagaaugugacgagguguucucaacucaaggcccacgggagaagagaaaccucauucuuggagugagagagaaagaaaguggugaacauugaacgcccucccucuccaucuuggccagagcguaggaagguguagaguagaggcucacggcuccugagacccaccucugcucugugcugcugcguagagcucucuccuuggggccuccagggcacaagcuugagggacagggcccaucuuuggucaggguauucggucauccgacaaugccuugcagguagaucucugcugugggaaaggaauggggugaggaaggccggaaggacagggggcagggaggugggcucaucacucugagccugcaggagagaggaaagaaugugagauuggauugugugugucugaggaauggccccauucuggucccuauuugugguuauuggucaugaagucaccaggaugacucuaucuuucuaguugcccaccaccuguggcuuugccuccguccccauauuucccuacccuuauaccuccuaucccgccaucucuaccccccugggcauuuucuggcuugccuggauagauuuagagaccugcuuguuggcuauaaugucuuuucauucuuucuucuuccuuuuuuaaaaaaaucagaacaaaaccaa

SEQ ID NO: 12487 - RNA, 21971 nt, Mus musculus
uuugucuuaauuucuuuauuauguuuggaccuuuaagaaacauauaccaucauauauaccacuauucaguaaaaaucuauucuagauuuuagggagcacacacuacaaacuaucuuguuucuagucucuaagaccacuacagggguuaucaaaaaaguagguucggcucugaucuaugggaucucgagucuugagguuuucaucacugugaaguaugcucacauggaugaacagcauucccauuuuccuuuuggaaugggccaaucacuuugaagucuguaguccauuauaagaacauuccauuccuuaagcucugccaucuaucgugucuuuggaaagccaaucugguaaaaaaaaguguuucuuuccccuguacaaaaaggaugaauuucccagaacacaucccagaucgacuacacugaacagcacucuagauaagcaggcgcagcucucaccaacaaggaauccacagaaagaacaacuguacucccccugcucccccacccccagugcccccagaggcaucucugugaucugugucucaccaguuucuggcuacacccuacccuguaagagaacuccuggugucugacaugggacauagaaagggugagugaagagacccccucaugauuucaagagggcacucuguguaaguacacaagacagggacugggaaagcuguggaugggcuggaaggguuuaaagcuauggcuuuggugagcaccacgugagcugaaggcagguauuuggaagagucgauucugcagcagccaagguaguucucagagaaugaugggugucuugauuaaucucagcucugagguuucagacguugagagcuaagaaaggugagcggcuggcauuaggcuaugaugcugaggguucaaagaccuucauguuguaucaacggaaaaguaaauaauuaauacacagaccacauaacaccauuaaaaccaaaaaaaaaaccacauuuuuuuuucauuuaaaaaaguuuuaggucacauaaaacaaggcaacauuuacuccuucuucucgucuucuggcacugggucugugggcggcuccuccacuguggcgcuguugcucucugagcccguguuacugucacuggucccuuccaccuccaugcugucaacccccuccugcccacucuccuuguccucaggaguagacgugccuucuucaccauucugcuggcucucugcugugucuucaaggugugucuccucugaaaccauacauuuaccaccaucaguuccaagaaaaacauucacucuuaacuauucugauggcauuggacagccacacguggagaagcccugagaugaccuaauaugauucaggaguauuuaccaauauuugagacagcucaggguacaaaaaucuacauuuuuaccuacaguauuacaaaauuuaaauacauaccaaacacauucguggugagaauugagauuuugaaauuaggaaguauaugaaaggggcuggagagguggaucagugguuaagagcacuggcuacucuucaauuggauccagguucaguuuccagcacccacaagaucuaaauaacuuuaaaagucccacagucuuuacauauucuuaaaauuucaaucucuuuaaaauacccaucucuuuuaaaauccaaagucuuuuuacaauuaaaacucucuuaacuaugggcuccacuaaaacaguuucuuccuucaagagggaaaauaucagggcacagucaaucagcagcucacaacugucuguaacuccuguuccaggagauccagaccaacacuuacacagagauacaugcagucaaaucaccaauguacaucaaauaaaaauaaauuauuuuuaaaaaguauauaaaauacacacuggauuucaaagcuuugcuacgacaacagaauguaagacagucacagccuugcguguguccgugagucagaggagacaaguucugcuccucagucacugugcacguuuuugagacaggcucucccacugaccuggaagugaccaggcaggcuaggcuggcaggccaacgagccuugggagcugcccaucucuaucuccccaguccuggaucaugagcaugcgcuaccaugcuuuuuacauaggagcucagguccaaucuacucagcuuucucucuagccuagaauguuaauaaguuuaaaaauauugauagauaacacugaaauauuuucuggagacuugguuuaaacgucacauuaaaaggaagccagaagggcuggugagauggcucaguggguaagagcacccgacugcucuucugaagguccagaguucgaaucccagcaaccacaugguggcucacaaccauccguaacaagaucugacucccucuucuggugugucugaauacagcuacaguguacuuacauauaauaauaaaauaaaaaaaaaaaaaaaaaaaaaaaaaaaggaagccagaagcgagaggcagcagcagcagaagcuucagcuacucggaggcugaggcuaagauugcccucaggagucugagggcagccuggacaacgcaguacagcaagacccugccugaagcacacaaaauaaaggcacagaaagaagcugagccacuuucuuaggaagcugaauacaagguucugacaucuccaauuuuuuccuucgguuccuccuccucuuucuuuuccuuaagcuagaagacggacaucggaguaauaaacacccuaaacauccagaugcugucagaauagacagaccucauucggggcagaacagacucaagacugagaauauggccuggcugcaaggugagcaaggaaccacacucugauuugcaagcgucugcgguagccacaaaaaugugcuucagccccaaauuuaugguugggaaaaaaaaaaaaaaaaaccccaaaacccccccaaaaacaaaaccagguucacaaaaccagaaaggagcccagacaaugcugauuaaaaccagacugucugaaaagauaaccugcugaguuaaacaaauaguguauaaaugcaugguagagauucucaaguuucauuaaacauugccaggaguugcuguuugaguacagagagaguaugcccgugucccuuuuaccagcaauugcuaguguccccuaacuaccuuugaccugcucauguuuauccauuaucagggucaauagugccaacaggcaaggugaucucaaaaacgccaagguuaaccaaagucaucaguauuugaucuaaguuuuaccuuucuuuucuuaaaaacaaaaaccaacccugaaccaugaggaaugccuuuauucaggaaaaccaaaccauuguucuagggcgagguuggucggcuaccaacauguaaagcuuagacagucaucacuguaggcuuugugggccaggaagucugucucaagucccaaaccauacacacacagguacagauauguauuaugcauacauguacacauguacauauacacauacgucuaugugcauguauacguguauauauucauguacacacacacacugcugucuccucaaagcugucacauacaguguggcagucaaacuuuacuuacagaauuauggaguaagacuuggcuuacugcuuuacuuugcccaaugccaucuuaggacaaagacgacauaucuugggaacaauguuauauuuuauguaaguaguagccguaaagguuaaaauauuauugccuauuauccuaugucaaauccgcagcagagugcacucauggaggcagguguuguucaaaugaggagaugagacagaaggcucaguaacgucacugucagcaacgggcacacaggcaggacccuccacgucugucucucuaucugcagagccacacccacccaccuggguacgacaggagcucagacaacaagacugacaccacugggcugcacuguggagccagcaacagcagcagugaaucuacuauggagaaagaauaagacuggagugucgcagggaaugacugaagggugcagacuguugaaaggcauccaggcaggacagccagaaggcagcugucagggcccucaccccuccuggguguggaggaggcgguuaccugucuccaucgggaugcucuccucaucuuucuucuccucggcuuuguucgccacuugcucuuccucaggggccaugcugcucugacugcgcucagccugcucugcugccuccuucucccucuccucuugccucuugcgggcuuguuccuccgccugugcgaucucagccgcaaucuucuccaugucuacuuccaccuucagaccacauaacugguugugaagaacacaucagugagcucagcauguuuucuuccgagaaacucagaauuaaguaaguugucuccuggcuuauguaauaguauuuacauagggaaaaggaaagcaauggcuuguccugaagcgacgggacaaaagagcugaucuagccaccaucaggcaugcaggggcaggggcugcugggccuucuaggacucggcuagccucaggaccuccacucacaccucaguuagcaaacuugggauuuacuuauuuauucagucauugaauuuuuuggcuuguuuugcuuucuugagauauauucucucuauguagucuuggaacucacuauauagaccaggcugaccuugaaguugaauccugcuuccucugcuugggauuaaaggugugugccaccaugcccagcgagacuuacucaaaaugcaacugaacuacaucuaaugaagacaucuaugaauaaauuacaaaaaagugaaaauaaauuacaacuacaaagauuuuaacaaagcacuggaggguucuauuaccugagggccuagucuuuauauguauacaugacacugcuaauuuauuauaaagauaguagaguuugugcugugauguuaguauuguuucaaagugaccaacacucaauagaaacauuaagaaaaauagcaacuggcgcaugauaaagguagucagugaauggaacggauacccuuuuaaguucauuguuaaaggaguccgugcuuuccaggaauuuccucuucuuuuccuggugucguuccucuaucugaaggagcucggcuucuaguuuccgcuguaaggugucagaccagauauguaucguuaugaguuuucucuaaggcagauguaaagugcagagagcaugccauuuaaagauauuacuuucaaguguaauuugacauuuccaucguguguacgugcguguggguacgcacaccagcgcaggagcccauggagcccaggagagggcaccgaauggccuggaucacagauggcugugaaucaccuuacaugggugcugggaacugaacucaggaccugggcaagagcagaacaugcucuuaaccacugagccgucucuccagcccacuaauuuugcauuacaaaaugaaaucuagcuauaauuuuaaaagucuagcauagaggcaugcugggauugauaagauguuaaugaauaaaucuggggggcauugaauaguaauguagcaaaggcugaugggaucccuaaauccuccaguuugcauccaucucuuaauagauauacaugccaccacaauguucuauuacaguuuuuaaugacaaaguuguuaagcuuccugaaugguccccuccuuucagccucagguggcucuacuucacaggucuacuuaugacuauagcagagucacacagcugcaguuagcucugaggcuauuuguaauuugaugcuaauucaggucuccugugaggggcugcacuuaggugauuuccugcaaaccuucuucccaccuuaauuggcaaaauaaaggcuagagcuggugauugggcaaaaaaagggaagguggagcugaaaguugagaggaggaggaggaggugugggagagaggagguagggaagaugggaguguagcgguagaucugcccaaucuaggggcacagcuuguauuccuauuaaucgaguuguguuuucauugcuggggcauauuaggguuggagaauuaccgcaacaucacacuaucugggaugugugacacagacuccuucuaguauaaugaauguuuucugaacuuaccugaugaaccauuaaagacuggaccugucgcuugaggaccugcauucuagcuguugugacaaccgaccgcacaucagguaccacacucucacugaggaucucacugaugagacggugguuucucuggaaacgggcaguggcugugugcuucauugaaaagccaucaucauagucuagaaugaaugaaauguccuggaaauuagugaccacuuaucacaacacaaugugaacaagcagucacucaguaagugugguccucaguguccuagcaggugggccugccuaacaucagaggcaucugggcaggcuaugguaagaaccacagagacagaagauacaacccacccaaguguuguucucauaaacccacuaaggcagugguucucaaccugugggucucgaacccuuugaggaauuaaacaacccuuucauagggaguacagguugcauacuggauaucugacuuauuagauauuuacauuaugauuaucaacagcagcaaaauuauaguuauaaaguagguacaaaaguaguuuuaugguuaggggucaccacaccauaaggaacuguauuaaaggcuugcagcacuagaagguugagaagcuauagugaugugugcugggcagugguggcgcacaccuuuaaucccagcacuagggaggcagaggcaggcggauuucugaguucaaggccagccuggucuauacaguuaguuccaggacagccagggcuacacagagaaacccugucuugaaaaagaaaaagaaaaagagaaagagaaaaagaaaaaaagaaaaagaaaaaaagugauguggugauguguaucugauauuugguuaaaauaccaacaacaaaugcucacaucucuuuuaguccuaggauccauguaacaccuacaugugauggcagaacuugaaauccugcccaauguuccauucuccuaguaauuaucaaaggcauuugauagaugcuacacuauaacugggaaguaguuuuaucaugguuguuaaaauuaaugaaaauauccauuuguaaaaauuaacuuaucaccaucuucucuaguaauauuuaguguuuucagguaguuuuuguuuuaucacauuaaaaaauaguaaagacccaaacuaaucuuguagaaaacacaacuugauuuaaaggcugggagaugaagcauuugcugggcaagcaugaggaucuaaauuuggauccuaggcagcauccaaguaaaagauggguguggcagaucuggagacucauuggucauucuagcuaaaauagcaagcucuaguuucacugagagagacucugucuaaaaauagugcagagaagcaauucaggaaccaucugguugucacucuaccuuccacauguaccuggagagggaagcauagugcauacaccgacccaaccuuaucacaagagaugaggaaggcacccaacaccaacacacacacgcacacacacgcacgcacacacacgcacgcacucacacuacucacagauacuugauucuaaacuuauuuuuaauuuugccaguugauacuuguacauggcuuguaaaggugccaucuaaacuuagguacauauagcacacauuuggcuuauauguuuaugugugggaguuguuauuuuuuugguguaaugcaugcaugugguuuacaggugugcacacacauguacauacauguggaggccagaagagguaacacgugucuucucuaucucuuuuugcuuuaucccuuuaagucaacaccucucacugaacuggaagcuuaccauuuuggcuagguuagcugcccacggaagugccagaaucugccuguuucagcucccagugcugguguuacggggaugugccaagccacgcaauuuacauggguccuggagaugugaaccgaaguacuugugcucacaccgcagggggugugaucuuuuugagacaaaauuucacuauguagcccagucuggcuuugaacucaaagcagccuuacuuccugcccuagucucuugagagucauuuaaaaagcccucucuaucugugugaaucuugugcugggaugcugagugugugccaccccacccagcauggaugcucguuuccaguaaccccagaguauuuccuuuauccugcuguccccuccauaugcaugguagcaaccugaaucaguauuugcugaauagucuuuuuacacuaacucauuaaacaaagcaaguguuuuccuccaauauaaaucaaaacaaagcuugucucugaaccaccuaaucccccuuuaaaaaaugauuuaugcacaaaugcucuuaucugcauguacaccugcaugccggaagagggcaucagaucucauuauggaugguugugaggcaccaugugguuucugagaauugaauucaggaccucugaaagaccaguugguguucuuaacugcugagccaucucuccauccagaccuaauccuucucgcacuucagacagaugcagggaccgugcuuuaggaaagaaacccugcuacauacagaggcuugcuugcugcugaagaaucauuuagaaagcccugacuauggaggugugagucaagguuagucuuguggaccuucugacacuccucuaagaagccaguggaugcugcccucacagacaaggccagacaaggcuucugugucuugguuuucugcacguuuccgucucucauguccuccuagaacugugguguaugacccagguguaugucgaacaacccuuccacagggcugcacaccagauagccuuuugauuuggaaagcauuggaaugcuuuaaguggggcuuaaugagccauccuaguaggaauauggaagacuguugcugagagugaucugaacuaugcggaccuggcccaagggguucaguggagaagaauuucaguauguggccuagagacuguuuuugugguauuuugguaaagaauguggcugcuuuuuugcccuugccugaagagucuaccugaggcuaagguaaagagaacuuauauuaacugcacugacaaaggaagucucaaaaagcccaguagagacuuuguucccugguuaagucucaugaagagcauuuugaauaagggcagcaagcuuagaaaggaaaaacaugaggagggucugggggacuuuugggauagcauuugaaauguaaaugaagaaaauaccuaaaaaaaaaaaaaaagaaaggaaaaacauaaaauauaugguucagguauuaaagggacaccaggaagucaaauggagcugaauuguauguucuaggaaauaagacauuaagggauuuggggguaaaaucccauccagcuaaauuuagauccaagcauguugguacacaccuuuaaucccagcaucacaggagacagagccauggggaucucugccuucaaggucaaucuacagagcaagccaguaagcagcacucauuccucuguggccucugcaucagcucccgccuccaagucccuguccugugugaguuccuguccugacuuccuuuggugaggaacagcaauguggaagcugaauaaacccuuuccucuccagcuugcuuguuuugugcaggaauagaaacccugauuaagacagggugugucaccugggugugguggcgcacgccuuuaaucccagcacucaggaggcagaggcaggcggauuucugaguucgaggacagccuggucuacaaagugaguuccaggacagccagggcuacacagagaaacccugucucgaaaaaccaaagauagggugugucagcaaaaauuuaucccagaauuuggaagcugggacuggagaaucagguaagucugggcaacacagugaggcccugucucgaaaaucaaacaaauccucuauucugaguauaaagacuuugauaaguaauaaauacagcuuuuuuucuuugauaauuuuccacccuguaaggaguauuuuuuccaugagaaagucacacgcaaaaaucuuacuacuuaaaaucuuacuacaacaaaaagacuuaaaauuaugcuuuuccauuuaaaagaauaaaaaugccuugaacuaaauuucuuuucuaauucagagagaauacauauacaaagccccguuuuccaccuuaccgucuggauccucagcaggcugaaugcucauguaagguucuccuuucuccaugcgagacugucucugucgacuuucuuccucuaaugcagcuuccgcacgacuuuuugcauuaauauaggcaagguacgcaggggaauuaugguaggccuucauagacucauuguacucuaucugaaagucaaaggggcugguuuuauaauguccauucuacuccacaggccaccugcacugucccucugaacaucagagggagagguaaaacaggaugucgggacagaacaaagaaugugccacucagaugagugaagcuugguggacaaaacugcaguguggcucagccaucuggucacgcuugguuucuuuuauaaauaauaagccaaggcaguccuccuaccuuuucugcuucguauucguuuaaauauucuugcuucucuucaucagugagaucucgccacaugccaccaauaaucuugccaaucucccacaacuuuaggucaggguuggaagccuuuacuuggucccagaccuuaaaaagucaauaguugaaaauucaauauuagugccuaaguauauagucauuuaaaaacacucuaauauggaaacguuuaaauacaagaaaaagcaaagaagacaguaucaaacuccuuuguagcaaucagccuguuucaaaacugccaacagcuggcuuaccccaugcccuccuuaucccacuggaucuuacucaccacugucaguugcucauaaauauuugaaacugauuaagcuaagggcaccacuaaucacugcucacacucguagagaauuaaaugaacucuaagucucuaacuguucaagucaauucaagguaguuaauuugucauacuaccaaacacauauguauuaacuaugaucaauauuuuuacuguacuuaugaauucacuugguacucuuggaauugaaccuaagcgcuuacuguagucaggcaaguguucuaccacugaacuacucccagacuuauuauuauuauuguuauuauuuuuugguuuuuucgagacaggguuucucuguguaacccuggcuguccugggacucacucuguagaggccucaaacucagaaaucugccugccucugccucccaagugcugggauuaaaggcgugcgccacuguaagauauuaauauauacagucuuauacucuacuuucuauuuaacauucuucucauguuuuccaauauucucaaaaagauaucacuuucauggcugcagacuaaucuguuuaaaaagauuuuagcaguuaauuuaaccaugcuccugaguucuggauuucugaaugagaaugaacuacuuaaaaaaguacaaguuuuaaaauucuucccucaaauauguauaaagaagacggcaagccagccugaaauugcacguaaggccauaggcggagcucuccggcacccaccuuucugcuguaccucauguagggcaucagcggcuuaucugguggcuuuggaggcuuuggaaucguaaugccagaggacgccuguaaaagagugaaauauacucauuauucaacugcaaggagcucacugccaccugaaaagaaagucccuuaaaaauucuaaugcgccuuucuucuacucguccauggauacaagauccuuauauuuccuccaaagaaaauagacaucacugcaaauucagaaauguuuuuaucagaagaaaaugacuuuaaacacaugauauuuaacguuuuacuuagcaguuaauugccacuguuuugacaagcugccugcaagaauaaaauauuauauaauaauccauacacugaaaauagaaguuauaugccaaacaccucacguuuagcacauuaccugguauccuuuuauucugcucaguaccauuacacuuacagucaacacugguuuaucuguagacucugagcucuuagcacuuaccauacacacacugucuacaggggaucuuguuaacaugucaggaaugcacucucauacauacaacauaaagaccaucucccagguuaaaaacaucaccaauaagaaacaggcgcuaacaagaaaucuagcaaauaaaaaaauuuaaaaaaaaaagaggaaaagaaaaaaauuuccuuuagaaauagagauuuaugucuguuaaacuuuuagucucauaguuuucuauuucugcagucuuggggcauauuuuucuuacaggggacaagcugugugaacucaaguuauacuucucuugucuucaugccuauggccgcagaaacacagagccaccuuaagcccugagcacgggacucccggccuugcuaucuuacuuaugaggcccaguccucaaugcugcuucuguggaaaagucacaaggacaaggaaaggcaggccacauggaaaaagaaaauacaagcaaaggggcuaaaauguuuucagaaugguaguggggaaguuggugagagaguuacgugcuagcuccugccugugaggaaacaggccaggagacaucagggacuucagcagaagucccauuuaaagcugcuacuccaagggcaacugguucucaacuuuucuaucuccuuguuuuaucagugcuuugauggaggagccaaaauaagaaguaauguguacuauccgacuugacaucacuaggggagugaguccugguccugacccucuugcaagaaugggaaagaggagugcuuuacucuaauuagcaaaaugcacaugggcagauccuugcugcucugacucacagacagaucuggucuuagccagcagugggcaguggaauggaaugagaccuggaggcagaaacugucacaguggcuagagcagccaccagggaagcaggcaccacaguuggcaggacucagagucaucaguaacuuuacaccauggaagccugcuucucaacccaggaagugacuagaaaacauuuucaauccagacuccacacgaacuuuuggaacacaaaguggguuccaaaaaagaagaagagaaaaaaaaaaaaaaagaaaagaaaaaaguugugccaauauuugaaggugccaaaauauuguuaacaguuaaaaauuuuaacauguguacuuuuaaaguuuuaaguauaaauuaaaacauuuaaaaaacaaaguuaguaauauuugcucauauauuccaaagacuauuuuagaacauuaauagauuugcuaauucaccccccuucccaaagaaauguacucaaauaauacugaauucauauuauuauugcacuaucaguuuacaaauaaaaaacaaaacaacacaaaacaaugcucucccauucccuaagaauaaguuccaguugguuugaagaucuuuaucaccacacaugaccaauuuacuuaacaucucugccaucuuucuaacggccucaaaaacauuugucugcucucacugagcaccuucaauccuuucuugguaagacucaacuagaaacagcugcuguugugugugcugugcucccgaguggccccggaaggagauuuuuggagagaccagcuucgcucugucuaugaggagcguuccuuacugcuaugaggacacccacccucagcgccgcuucuccaucuauccaaauucugucuucccaguccuaugaacugggcgagaggaagcaaauacuuaugcuugauaaaacuguccuuaucuaaaaguuagguccuaggcaaucuggauaaaguccacaaucuugugauugauucaucuuggacagugcaaaaaaauguuuuucuuucucaauucuuagcuguuucucugguaaggucuuauuuaugaauuuucuuugggagagaggaguucuauuagcaaggaguaaaggcugcuuuucacauuuugccucaaucuguuuacaagccuguguaucagagaacacgaaccaucaccugaacagagugaucaggcuugggcuacacucaaagcuguccuaaguccuccaaagguguuaaucugguaccuaagugcuuauuuucugaaaacuacccacauggaacaaagcucuugcuuaggguugcacagaaucauuccccaagucacuguggccauuuauagacaacaguuuacucaggaggaacauuccccaugagugcgccauuggggucauucucuacaaacaccuuuuauaagcgagugagucccaaaacaguaaggauaaaagagaaugcaaaccccugggccucuagcaguuugagcagccuucagucuggugauaacaggacaaaaggacaagaauacaaggaaacaacuacaaagaacggaaacaccaaacuucuuagccuaaccucuccccgauaucgaagcuagagcucaauuuucugaguucuuccauccccaggaaggaaagggaugaaaacagaugaccaaccuaggcccagacaaggagucuuucuccuuuuuucuaguuuccacuguauuaucuaacuuuaugucaacagagaagucucacagcuacauacaaacuaagagcuggcuguuuauacaaacgccaaacuaaguuacuguaggaucacauggauacuccugucccacuaacauggccaccaagagcuuuaaccguauagagcuagccuuucagaaccaucuucuuacucacuauccauaaauacauuucugcauuaacacaaaagaucucaaacuaacugugcuuacuguaugaacuauaaugcucuuuaucaucugauaaccuugccucucauuccaucugggaaacaauacauuuagaccagggaaaaacauguauugcugcacacagugugugcagcgcacaaugcacgcauaaaaaaauuuuuugucagaacccuuuucaaauacugugaaauacguauggcacauagaacuugauaugcuuaugaaguacaaauuaugcaaaaacaaugaaaaaauuagacaaacaaaaccuauccagcuaagcaauaugcuuaccaggacagacauacaauuugagagugacgaguuuucagcucuagcuucacuccagggugagagggcuuuuuuuaugaauacagaaaaugacaaccauacuaaaaaaaguacuaaaaaguuuacagccaucuguguuguauauauucucaccaauaccacauucuaauggagguauuugacuuuuggauuuauuaccuuaauuuccuuugaguuuaagauaauuuuaaaauaaaagcuuugaaguacaauauccaauuuugauuaucuuaguugaaucacugaaaugaaauuccccaaguuuuaagaaucaucugucuacaauggauuggaaagcuauacuuaacaccuggaauuaauucuauucaagguuuauuccaaaauuccuugaggugacaguaaaaucuuuuucuguauuaaacuggaaagaaaugagucucagauaugucacuuacuaaauccaaaagacaaaccacuaagaguagaagguugacaggcaggucugccaaagcuuucaguccagacaaagccaggccuucaaagucccagcauuccuuaagaaacuauguccuugagaauaacgccaauuaccuucaacaaugaaagauacucuucaugccauaaaguauuuuaccaaaagaauucuacauuuguuuacauauauaguaugagcauuaaggguccaaggcuuuaucccuacugaucaccaaguagaaugggauuucuuuucuuccagguacauauccagacugcacuuuuuuuuucaguguaagacuguacaaaauaguugaaaagucagguuaaauuuuuuaaauggcugugcuucugauucaaaaggaccuagcucuggaggcauuucuggucaauuccaguuguuugccggaggcuguaauaguugauucuccuaccgugacccggcuguuggugcccggguucccucccagccuguaguuguuguaggcgagaugacuguauggauuguaucccacaaacccuggugugcugggcauuugcugauggaaacaaaugagacaaaaacacgaaugagaaaugagcucaaacgagggaaacacagaaaugaaaaaugaucugcauauggcaugcaaaagcaaccugaguuuaaacaagcaaugaugguucuaacugguauuuguuacuguuucuuuuuuccacugugaacccagccugcaagucugcacgugcaugcguguaugcaugucucuucucuuuccugcuuuuccuugguggggguuagggaugcuugggagacugaguauguucuguuucguucugaggaaagcaucacacuaccguugcaaacaucuacaacuauuucauggucaacaguaugagauaauuuagcaaucugugauguuugagauaggaaagcuucaaguaugauaaacuuuaaagucugaaaacacuacaugcaaacaaaacaugauuuauuugacaguuauguggaugucaccagugcccucauuuacuaaaaacaaaacaaggaauggaucugcuuuuccaagacagcguuaaauaauuuucuaugugacaaaugagaagagacugaaaucaggaggccaggaacugucaauaggauagaacauaugcucgauucaauggaugucacaugcaugguuuuaaaacaaggacuuguaagaaaugcauagaucucauaauggugcuaucugaucucuaaccacgucauucuuucauagacuuucucuuccaucucuucuuugauccaucuuccauagguaaucaucaacaguuuaugaauuuaauuuuaauaguaacuacuuuuuuuacuugacagacuugaacuuucuuuuucaucugauuuccugaagucucucagccuuuccaaauacaacugcucacugcagcaacaaaacucuugauuuuugugaauuacauguugauauaaucaccaauggguucuuauguaauuguggccuuguggcuaauacaaugacauccaguguucauaaaaucaaggcaaaaugcauaaaaagaaugugguaaagaagagaccaaaaguguaguugacuuagugacacucagucauaacaagugauagcaaugccauuuuuacaugcaauuaacguaacucuccucaauucuacaaaaguacacgucacacauuccagcuaaacuuaguuguuucaaaauaaaugccauuccuaaagcaugcccuuguauauagccuuaguauccaaagacacucaagcaggcagcacguguggcacuuuuuagaggaagacaaagugauccauuauagcccauauaguuaggaaagacgcaaauuaagcauauuucaguagcaaaacacagaugaaaucguaaaggcacagaaagggcguguuccacggggaguggcucauuggagagguggcaguggaagggguggguggugauaauggugguaaaagcaaugacauuuaaaaaagagaaagauuaacucauuucauauccauuuugcuggguguuauaaucccuaguuucuagauuuuguguauaaaugugaaauuaugaugaggguuaaacaaggaucccuuucuuuguaugaaaacucagaaggggaucuugguuuuuaaaauauuuaguuaaaaaauaauagcaaguuuguucacuagacacuccuggagguaguauuuauauaaaaaugacaccuccgaacacugauuaaagaacaacauaagugaauaggggaauuuaaaaaaaaugaaacuaguauacugcaauuacaccauuucuaaaguugaggggccugcuucuguuuuugaggugagacuuuuaaucacucaacuaaaccagcacacaaccaugaguggaaugugauggagauggggguaagaaauguucuuuaagaaagaaaaaucaugaagcacacgacuuuacaguccacuggaagcgacccugcagacuguauauuacauggagugaacuuaagaauguaugguaggccuuuuaaaaggagcaucuaaggagaaacaaacuguugauaaauguaacuaaaacaaacaccuauggguuaguaaaucagacuaguuaguuaccuagcagagaaaacaaacaaaaaaggaaaagacacaggaacucauuaguaauaaaaguagacuagccugcagugaguugguagagggaauggaaggaagagcuagcagauauuaaagaauuaauuuggggcugggcaugcugauaaucccagcguuugggaggcugaggaagaaggaucaccauuuggaagccagccugggcuacauaaagacccugucucaaaacaaaacaaaacaaaucaaaauaauccugauucaaauuuuguaggacgugguuauguuaaguggucuuuuuguuguuguuuuaaaaugguaagaaagccauuucagcauuucagcaagggccuguacaguuugcuguuaaaguggacuugugauuggauaguuauuuuacaagcugcuuaagcugggaagagcuuguuggguaaaaacaguucacaaccauuggacaccuucaaaacagaucagccggcaagccaaaacagaaccaaauccaguagcaagagcugacccauggguaacgaaacccuggccugagcagcuuuaaaauaagacuuaugagcguaacuauccuuagaacaagaaacuuuauuuaaugugaaauuuuuauaugcugacaagaaaguuuaauuaaaaaagucguguugcugggguuccaaccuaggacacgcuaggugagugccuugccacugagcuacccagcccuuacggugagaggaaaauguaaccgguugaagguuaggcuuaaaaacaacaaaaaagaauaaaggaugccagaacgagcauuuacucaauaucaacggaaagacccuucaccagggaaaaacggcaagaacggaguguuucacugaugucccguuaggaaacaaagagcacaggaggcuggaagcucacaguauguauuuuuaaguguuggguuuggcucagguaggaugaaaggaguuauuuuauuugguaggaagugcuguuuuuuagcugaauugucuauccuguggcugugaugacugagugacugucaguggaagacaucuggguuuuuguaucaaggccagacuuggcuauuacauuaacaagaaaauuaaaacuuacuguugcaggagcuggggugggagguggggcauaagauggucuuucuguuugaaagaaaauaaauaacuucuuguaaacaacugagauauaauacuaugcaacaaaacuaccaaugguccugcuuugaagaaaaaaaaaaaugagaguauuuuggaauucccauuugcuagggcauuagucucguauuaacacagauugauaaauauaaaaauugaaacuuacuugacauuuuggaagauuaaguucucaguuccuuaagaaugaaucugagacacuaaaauaaaaaaaaagaaaaaaaagaaaaaaaaagagaaucaaaacucagcaagcauaagagaauguuuuccuaaagaauaggguaguuugguauuucugagcaaaauuacuucacuauuaauugcuaguaaucaagccuuuugcauauuuuuaacuaguucuuacauucauuugauugaucagaauuaaaugaugaaaauaaauuacugggaaauuuagaguuauauuagagauggauuuuuagguuuuugcuuaugauacugagagcagcgucuuguauggaaaacauuuugcugaugccaugcaaacgauuacuuagacugauaaaaaaaaauaaugacaauagaaugugauguauuauccgggugaccccaacaaggccuaccagauacugacaaccccugauuagaagcucugccuuauuuagggaacaucuuucauugaaacagagucaugucuuauuccuggaggcagugugaaagguaagucaguaugauaacaaacuuuacauucucuuuuguugguaaauaguuucauaagagccgggaacaauuuucugaggcuacuuacaggacacauguuguuccuuuacagcucauuucagaaauuaucucagguacuuucuugauacaucaucgggacagaauaaauuauaucucgucucuguauuccuacauggcuuacaaagaccagcggcacuuucccuccaacaacaugugaaugugcuagguuuugccuugcaagagaggagggauggucuaauuuauuacuguauuauucaaacauagcucaagucuucauaaauuugguccuaguauggccagcucgaaacauggacauaucugagcuuguuccuuacucaacauagaccacaaaugguaaugcauaagagaugaaaacuuauuuuuagaaggauggugaauacacuuuuuuuucuccuaguuuucauuuuaaggaagugccucaaaucaucaagguaagaguuucugauguggaaauagcuaaguuuuuucaauucaucucuuuuuuuccuuccaucaacacccaguaggccuugcuguggggagccccgacagaaacugugacagggucccugguaccuuacacuucacugcuaauacuuacaaaugauugcucucccgggcuaagcauauaaacucuaguagugaguggaucuaaccauugugccugggacgcaacucuguauuuauugaauuaauuaccuuacuggucaggcuuauaacacagucuuacucacuagucacaacgacccuacccgaugcguaugacuguccccauuuuacaaaggaagaaaacagucucggggcgauuaagugucuaaggccagagacccggaauugucagagauggguuuaaacccaacccacaccgucucagacuucacuccaggccaccccgggaauccuuaagucgcugccugaaccaaauaaaaaauaaaaauaaacaaagggggggggggacgaccaccuucguggugggugaggauccccgcuggccuugcccagaggguuuccggagauccuuucccuggaguuuuguggcgggcggagggcgagcuuuucuggaaacuccccugcaggggguugugcauuggugcucaccggcgucgggagucccgcggaaagggacuaccggcgccuccgaggagcuguuccggacgggguugccccgccgccgcuaggccucaccgaggccgcaccggcucuagcucccgccucgcagccgaggccgaaccccagcaccccgcgggagcucggggucccgccaagcagaaacaccaccgcucgccacccuuccccgaccggguugggcccacugggaaacacucacccgcgggccgagcaggcgcccgcagcuccggcuucgcuucccuuugucccgcgcucgccccgccccucgcgccggagcuuccgcgcucgcacuuuccacacgcucccgggaauugucugccggccgcggccggcucccggcagacgaacagcccuuccagugagcacgcggcgaggcuuagggcgccaaggauuuuuaaaaaaaauuucgucaggcuccuggguuuccucagaagucuuccaauuuggaucccgucccagucgggcgccgauucgucacggcgaggagggcggagaaggcugggccgcguugcgggcccugguucgcggcccggcggcaggaacugcgcagacugcgcgcccggggcuucacugaggcggugggcgccgccgcgugaggcgggcgccggaggggaaaggcucgccggagccucucccgggagagggugggacgcaguucccacacaccaugcacucuggcuuuucccuucgcucuggucuucaguccuccgcugauggacguaugaauggagaagauggagaauguaggcggggaggacccgggucgcugcguuuagguccuugcuggcgcccagcggggcuccccugccuccgcc

SEQ ID NO: 12488 - RNA, 25768 nt, Mus musculus
uagauuugcaaaaaccaaaccaacaaaaacuuuauucaaaaacacuguuuacauaaauguugaguucuauguacaaaauauaaaaagcaucccucugcuuccuucagagagguuggaagccaggacuccuagucggcuccuccuggcugcucugucacagccuccagggaagagcugcugaagcgauuucugagaccacaacccauggugggacagugcagggcccguucuaggucuugccgcccagcagaguggagcagacugagcgcuccccacccccuuccuucagacaguguguacagguuuugugugcuacagguuuuucgccccagguuuccuccucccagacccccaguauuccccuccuuucugauauaauaagcaagguugcaaacaggaaaggaagaaaggaugaggccacguguggucaugcaugccuguaauccuagcacucuagaaacagguaggaggaucauucauggauagucugggauauauggagagaccuugucucaaaaaagcaaagcaaaaacauaaaaaaaaaaaaaaaagcaagaaggaugaauccaucuggaagggugaggauaucgaauggagaaaagggauggugggaacguggacaaggccguuagacuugaaucucacguccauccacccuggcgcaagaacugacacucggcuguggcagcccucugcuguguugaagggaacagcuuaagcacaccgagcaaucacaaagucugcagcccguauguauacacaaagguauaaagggucacuaagaugaaccccaaucuuccaccugugcgaggacaggagcacaccggucugggcgaagcuucuagcuuaggaguaaaacuccaacuuaguugccuaaaccugccucccugccuuuucuagaauuucacugaaauggccauuggacagaaaaaggacaccggagaaauagguuugucagcaaugauagguucagcucuuacacgagaggcccugggggcccuugaggucugaacaaaaaggucaccaccgcuuuagccacaaacccagaacugugugggcaagguagcccugugaaacgugcaaagccauuguugguaugaacagagauacuacaacugacgugggcuccucacacugaaggugguuuuccaagagaagcauggaguccagcguucaggacagggagcuucuagcggaggugaagagaccagcagguggggagaggcgggcgucgagacuguccaugggccggcguaaaaguucuuccacgugccuggcaacauccaugcucucauccaggucaaacucgccaucuuggucaaggacagggucagggcuggcaaagagagggauguuggagaaacuggcaggucucauggcuccaaacccccauagagcguccucaggcugcugcucacaaagacuggagucuccugaggacaggacccauggcagccuggccuggaacucccaccaggcuggauuggggaagauaaucuacuuccauuccacucuugcuucauaccaugaucucagggcguuuuccccuugccuguacuuauaagacaaggugacuggccacucaccuauguaugacauucuucacuuacauaugcuaccacauccuucaugaccccccccccccguaguggcuuucagccacugaccacuaauccuccaaaccaucuuaaagugagaauuaggaacugggaaacuuguuuggagccaccugcagcuagaaucagacucuagaucuuggcugggugugguagugcaggcuuuuaaucccagcuuucacuuguaaggcaaagacaggugaauuccaggccaguaggacuacauagagccuaagaaucagagccuagggcuugaaugauaauaccaucaugaagcucaccccuccauacaauacacaucgcuaguaagaacuuccaaaggaggcugggcagugccugagccaagggacugcuucacacgcaagaggaccugagguaagaucugcagugccuacacaaauaucgguguggcagugugucuguaaccccagcacagggggguggggaagacagacacagggggaucuuuggaacccauuggccagccagccuaggcaaauggguuucagguucagugagagacagaucagaaaauaagguggaaagugauugagaaauaugucuggcauugaccccuggucuccgcacgugugcacacuugcacagagcuacauggacacguagaucuauaccauauacauaaaugauaauauagaggcuggagauacggcucaaugaugcuugccaacaaaucaauccuggugacuugaguucaguccuggaauagugggagcacagaacugauucaugcaagcucucgugcucucucucucucuucucucucucucucucucucucucucucucucucucucucucucucucucacacacacacacacacacacacacacaacuuaaaacuuuuaaaagagaauguaagucuuugugauugccacgugcuguccaacugcagugugcuaccucccuaaacccagguauccagccuuggccacuaucgcuuagaaaggaccaacucucccacuccuuccuuguauccaugccaacagaagcagcagcagcgucuuacacccuucugacaacccuacauguaaagguuccacaucaccauuccauuugagccugaucccaauuccccacccccaccccaggggagguggggaggaacaccuguugccucuacaugcaccugagaaaaauuucucaggaucauauaaacuguaccagaaagaggacaggacccuuguugucuaguuccaaaaugcucugagcgacugacuucaccuuccuauaacuugggcagagcuacagcccaggccuggauaaagucaaauucaggggaccucuggaugcuuuuguaccucaagaaucuagccugaggcccagccccaguuucuccccauggaccccuguaaaaccaugaccuacuuggguggguacauguuguagugagguugagggcacacgacuggggaaggagccugguccauguagguggcgcuggcuccggcaucuguggaugcauugacgaaccugcaaaaaagaagcagaccucggccucaggguccagagagaccagugguacagauggcgggugggggugggggcuucuagcaucuucaugucauuugaucaaaguguccccauugggcucugggacucaagcugcaggcacgagguccugggugcuaucccaggacaguugaaucuuuccuucucaagggcuuaagccacauuucccaguauuggagguagaagaggacagagagguaucgggagccccagagcuggcucuggacacuuacucagggaccacuugcuugaucuguggcuucacguauccgucaacugcuuucgcugccgggcagggguggggguaggggggaagcgcaaugagcacaacuugcccucagccuccugcccacgcugccuggagcuuucugagggaugcgauuucccuaggacuuccgauaaaccccugcuaauggacccagcgugagggaccacugagaucccuggcuuccuucaacccuauccucucuccugguuucuuuccugaccauuugcaugccugccaaggaaacggcuucaacaaaauacaaaccccaccaauggaccaggaagauaauuuaacuuggggcggguugugggggucgcgaaagugcugagagcugcugguuagaggggcagaaaaguaacucuucaugggcguggccccagcuccucccuuggcucucgccucuuccuugguggguguagaauugagagaagcuuucugcucaggagagaagcaagcuggggcagguuucccuuucucucuccucagguguacccugaaauccuccaugcugagacccaaagcccauaaaggagauggccccggccagcccuccuggaagcgggacucaccaaguacaggaguguaauacuuggcaaagaccucguccuugggucggucugggaacacguagauaagguaguucaggucccccagccggucggccagggaccgaauggagaaaucucgcgucgugaauggcuucagauuccagagguuucgguccgcugcaaaaggagcaauuuguuccaaaagcgcccagucccagaggaucaugggauuuuaggaagaacugcuuuaaaaaaauucagagccuuucucagcaugaccugcaacccucgccuuccuccuuccucacucaaggaagcucaugcuggaacauucuacucagcaaacagcauggaaggggugaggacggcaugaaacuugagggucucaccaggugucugcugucugugaagucagugguuuucgguucuuggagaccaaaagucauguggagccauuucccuucccacgccucccauacuuuaagcucauuuccugccucuaccggaagugggagcuggcuaacgacaggggugcugauggauacgggagugaagagauggaagacaagaacucaagggguuggagugugagcaagaugggaacucacgagagucaaacuuccaagcaauggugaugcccccgauuuccgagucacugaagcgcagcaggaaggucccguccggcuuguugaugagcaggucgugggccuguugcuuguucacgaaacccaggauagcccugggcgggugguacauggggcgucauugcuggguaggcaggcaccauucacagagccuucuacccacagcaggcccccaggguccugauucuuacccaucauuccaauggggcuuauggugcuucuucagcaccuccaucaccccgucgaaccacugccagaagguguaguuccagccgggcaaguucuccugugagcgccaggaaaccccacgucacagcagcucccaccacgccugcucccaacugcucagcagagcaugaacugacccccccccgcaaccccccccacacacacacucaagucuucaaguuucuauacauggggcuauccugugaguggggcagaagcuaagaagaguugucugugcuggccagauccaccgagaucauuucaugaauagauggagaaauggaggcaccaaaggccucaaaauuaauggcgggcucgugaguagaucucagcucagggcuccccuuaucauccugcuucgggucacauggcugaacuugaugccucguggucccuguuugcauuucuguggucuaagugucaaccccuccugauuauggggagugugguugggaguggaggaugggcugcuagccucaagacggcagauagcuagcucugguggccagccucucacccgguugaacugggaccaggacacagacaugcuguuguaguccucgaggugguugcugcugauguugaacaguuucugugccaggaacacgagguucucuuuggucaagccccgguugcucuguacuucagccuugaauuucauguugagcgcuucacacagcugcggccacagcaccuugucaggcacagcaaauggcacccugcccugagagggagaggaaaaaaaaagauaagaaagggaagacugagggagcuggaaauguguauacacacacacaccccugagauaugcuugaaaccuagcuagacccuuaggaccugccagccaaugggacaggcacucgccucacccugcccgccucacugucuggcucagcucuggggccuaaccugaggacaauuguagggcuuacaggccaagggagugaacccagaagaacucaccggcucagcaaaggcauugucccacagcacgguggcaguagcauugugguccuggcugccauggacgauaacgaccacagggagggacagggucuauggaggucagagaguaaggguugaagguuuucaacacagugugcccugugcaggagaauugagaccccugacccuuaucgcaaacccacuguucaaccacagacccuuccaaccguucuaaacaugagcaaagcccaggcagcgugugcgaggcuuguuggcuuaugcuuagugucccagugucgggaagauggaggcagggcuguggagucaaggcuagguuagucuauauagcacgacuuuggucuaaagcaaaacuacagagccccaaggguauauuucuuuuuagccuauugcccaaguaauugcugaacccagccgucaggagccugcaaaucuacagagguucacgggguaacugggcugaggcaagagcacucagagcucuaucauuuguuuuuccuuguuuuucaagaugggguuucucuuuguagcccugacaguccugaaacucacucuguagagcaggcuggccucaaacucagaaauccaccugcuucugccucugagaucaaagauaugcaccacuacugaauggcuuugauauuuuauauuuuauguggguuuuuuuguuguuguguuauuuuguaaacagggucucauguaucccaggcugguugugaauucccuauguaaggaugaacugcuccucugaccuauaucucugggguuacaaucgugcaccacuauuccuggguuuuguuuuguuuuguuuuguuuuguuuuguuuugauggugcugaggaacaaaacuaggguuuccagcuugcuaagcagacacucuaccaacugagguagauucccuaaccugcuuucuaaauuguauuuuauuuuuuauuauuacaagugugugugugugugugugugugugugugugugagagagagagagagagagagagagagagcauauugcucuagcaugcaugggggcaucaaaggacaauucuucuauuuucaccgucugcuguaugcucuagggaucaaauucaagaucucaggaccauaaagcaggagcuugcaccagcgaggccaucuugcaaguaccacauuuuuguuucuaaagauuucucaugugcaugcaugugcccaaaugccuggauuugcagaccacauccagaaaggugacuguggaggccagagaggccgucgaauccccugcaacuggaguuauaggugggugugagccauccaguguaggaucugagaacagaaccuggguccucugcaagaacagcaaaugcucuuaggugcugcugaaacagucuccagcucuuuuuuuguuuuguuuuaaagauuuauuuauuuuuauuuuauguauauggguguuuuauccucauguguauauauauauauauauauguauauguauauguauauguauauauauacauauauauauauguauauguauauauauacauauauauauauacauacguacauauauauauauguguguguguguguguguguguguguguguguguguguauguauguauguauguauguauguauaucccauauucaugcagugcucauagaggccagaagaggguauuggauccccagggaccagaguuacagaugguuguaagcuguucugugggcacuaggaauugaauccagguccuccggaagggcagccaguguucuuaacuacugagccaucucuccuggccuccagccccuguuuuuguuuguuuguuuuuguuuuuuaagccaauuuuugcuuacuuaaaaaaagauuuauuuauuuuuauguauaugaauucucugucugcauguacaucugaaugcaagaagagggcaucagaucacauuauagaugguuuugagccaccaugugguggcugggaauugaauucaggaccuucagaagagcagccagugcucuuaaccucugagccauuucuccagcccguuuuguuguuguuguugguggugguguuuuuuuuuuucuuuuugagacaugauuuuccuugguagcuuaggcuggucagaaucuuacuauggagccuaggccugcucugaaaacuugugguccuccugcuuggcuccuaacucuggggaauuacagguuacagauaagauggaucacacugucacaccuaccucaaccugcagcuuucccacaggcgcuaggucaccuugggcaggucccuuuacuuagcuggauggcccucauggguggaguagcuggacccucaccuucaccuggaacaccagcucguugcugccaacgcugaacugagacucaaacaggacugugaacuucuccuccgucaccgacucugcaccacgccugucggcgcgcuugauucuuuucagugacugcaaaaccggggauaaaauggccaccaagccccaauccugggcagaccuucccuccacggcagaccauuccucaccauguuucugaagugggcgcugagcgugccaguggccuggugguacuccaugacgcaacaguuguucaggaucucgccgcugcacucacugccaagagagaagggcuuggagucacagcguggugccaaggucuaaccgcaggaagggccuugugcacaauggacaggcacggcaucacuaacugacaucccugggccugggagacaugcugcuaaugggaccaucaaagaugaacaagccuccaggauaaaagccucaguuguuugugcauucauucacucacucacucacucauucauucauucaagcacuauauggauaacuuguccugaccuguuucuccauucucauaugccucucuacgcucuugcagcucaacauguugugucugccugaaaacaaacagacuccucucuccccaaccccugaucccugaccuucauucacuacccauuccacauccaaccgugaccugacugugacucuucaagaacuuuguuuacuuuguaaggcagagucuuacuaugggucucacuguguggccccaaaacucucuagaucaaccuggccuugaacucacagagauccaccugccucugccucccaagcacuggcaucaagguaggcaccaccauucccagcugaguuugcuuguugugguuguuuuuuuggguuuuguuuuauuuuguuuuguuggacagaguuucuuuguuguucaagugggcuucaaaucgacuacagagccaaggaugccuuugaacucuugauccuccugccucugccacccuagaacugggcauagacacccacuccuggcucuaaaugucaguucuuagcaccagcugcaugaggcaccauaagugugggcaccugccugucauucaacugugccagccgucaugguucacugaauuaagaaugcucuaaggucagugguccaguuaggaaacaggcaaguucucuuuugaucccgguugugugcccacugcucagcauacaugauaggaccacauggcaguggcaguacauaucagcacuggcugcccuacuaggugucacacaggcaaggcugggaaagcagagggagaggaguguguuauggagaaccaggaacacaugaacaccuggaagggcugaagccugggcuuugcccacguacggaccccacaaagcacccgugggaagggaaagacacacucacuugcggguguucucauucuugagcagggacuuggccugcugcucgcugaugauggucgccuucaccugcgggggguucaugugcacauucagcuuuccccccaccagcaggcgcacgguggccgcaaacuuggucugggucuucaggaccugaggaggcugcuucucgaugaugaacgugcugcgggggacacaagagaccagacaguugccacaugcuggcucagggaagagagcugggaggccagcuaggaaggaggggcuuucugugggaccuaaugggagaagggagacaggcagaggaggagggcgccugcccuuguuccagaggaggacauggggguugaagacaggugugagggaggcuggaggcuauggugcuucccgcaguguccccaacacacacugggccaggacagccacagcagcagagcuauggagccacagugggaggaagaggagcagcggaguaggauggggcggggcagggggcagagcucuggguuuggacagcuccagggccucaacgugcccaccccaggaacugccaugucccucugagcauggccaggaggcagccgucaccuggugaccagagcugagaugauguccgugaugguggcguugaccucagccagcaucuccuccacggggccugggaugggcagcugcuggcacaggugcucagcccugcggaucugcugccgguucugccagaugaucucggccagcuucucacaccugcaaggagcccggggccuucagggggacggcggcugcuguuccagcccaggccaggggaggaagaugcaugcuacucuuccuccuucccaccaaagcaccccccgccccagaaaggugcuggccuuggccaccgcucuccugcacaggcacacugagcagagucccacuuuucaaaagcagaagacagucaggguggccccaacuuggaaccaaccagcucaaggguagcccugcccaucccaaggcaccacugucccuugugggagguggcacaggucugaagagccgagucccaucaagagccaagauacugcuaaagugagagcugucacagacagugggcaucugcugcucacgccacggcagggacagaagaggcagcuggcauccuugcccaagcugcccaccccgcccaccucucacccucaccaggacugcagcacguccaggcugcccucggggggacccccguucccggccagcugcugucuccgcuuccacuggaucagcucgucguccaggaugauggucugcugcuuccgcagcagcugcagggucuucuggugcuucucagccagcuccugugcgagggaacagcggcucucuggcucccggcgagcaucccucagugccuggccuagaacccagggccuggcccccucacacccgcuccaccccaggagagaggggcccugcucccauccaggcucugucccccaccuggugcccugaaucucaggugacagagcucccucuggggcagagggucgcagggcacgcacuaaccacucgguacugcugcagugucugugccucucgcugcagccaggucuccagggacacuugcuucugcuggagggccgucucccugcucaugcgcuccuggggguucagcuggcccagcugggcaaacugagcuggaggaggggacagggcaucaucucccauguccaucaggaaccuuauaguaucugcacucauaugcucuggagugagugucucacucaggcauccugucuguaacaagucagggugccuccagacaugaguggcaaaggaugugcccucagaagacagcgucuagacugugcucauaagccucuugcugcauguccccugagcagugggagcaguguccagagugaagcagaagagggcccuagcggcccugccuggcggcccuugccugcccccucccccacaacugucagcaagcuuccucauaggucucaagaauggcacaaguagcccugcucuuucaaagcuggguaaagaggggcuggggagguggcuccaagguuaauagcacugguuaccccuccagaggaccuggguucgauucccagcacccacacggcaacucacaacugucuguuacuccagcuucaggagauccaacacccucacacagacacacaugcaugaaaaacaccaauucccauauuaaaaaaaaauaaaagcugggugaaaauggacaaauaccuugcuuucccgugccucaguuuccccauuuguaaaaaagggagaauccugacaccagcucaguaggcuauuucggugauugaaaaaacuaauggcacugucacacguaacaucuaugcagguugguccuaauugguggacagacgaagguuacaaaugaggggugacagagacaagccccuucagcccggucccugacauggaagccccauccagaggcucuggcucuuccaucuuauucauucacccccugaguucagcaguguuugcucaggagcagugugacuggcugggacugcacagugcccaggaugccugaugggggcugggggugggugggagguggggagaggguggagguggggguggggcaccaugagcucaacugagcacccaaguaagaaggaaggagaggcggacggacagauggacagacacacaagcauucccaggcuccccuagaauauuauuaguguagugguuugaauauguuuggcccagggaguggaauguagucaaccugccaccagguugcuggcucaggauuggucucugcuguuggcagaucuggcauucagcaccagcuguagccgggucacccuuggugauugaagucuguguuguugagcccaaguauaaccuccaucucaaccaccauggccacuuccuuuguucacgugcccauugaacaaugacagggauggcuggggaaagaggcugacuguccauagaacgggggucaucuuauccacuugauuccugaacuccuucuuagcugaagucaccuuuuagugaguauuuacaugggacacaaauauugucgcauccuuugcccauuuggagagaucuauccacacacuucuucccagaugucuuucucaccaauuuuccaaucgugaucuuuccaagucucugaucauccauccagccaauccauuggcuacagcccaugagucagugagcaacuguauaucuggccauuucuucuucuaaacaaacuaacaccauauauguacagccugaaguucugcccacugugaagauuucccuucaccugugucuuucaggguugucccagaaaaggguuguaauacuguggcuguccacuucuggguggugccugcauaacgugcagagccaucaguaaaccaggcccuagucuucucuucucagucagccaaccacagggaacaccccaugaggcuauaggcgcaugcuuggcagcagauggcauuguaacaggaguagaaaccauaggcauuugaacaacuucuuucuuggugcuaggaggggccaggugccauaacuuaucuuucaccuuagaaggaauaucucugcaugccccacacuacuggacuccuaagaauuucacugagguagaugguccuugaauuuuaguuggauuuauuucccauccucugauacgcauauuuguuaccaaugaauccaaagcgcuuguuacuuuugcucacuugguccaaucggcauaaugucaucaauauagugcaccaaugugauauuuuguggaagagacaaaagaucaagcucccuucuaacuaagucaugacacagggcaggagaguuaauauauccuugaggcaaaacugugaagguauacugcuggucuugccaacugaaagcaaauugcuucuggugguccuuauggauagggacugagaagaaggcauuugccagaucaauggccacauaccagguaccaggagauggguuaauuugcucaagugaugaaauuacaucuaaugcagaagccucaagaucuccgugccaagaaucccggucagaaacuugugucuuccagccucaagaucuggaugacagguguacccucuggcucuggauuguaguucacuccagauguugucaaguugacaaccaggaauagccaccacaauuugcaagauucucauaaggaacaaggcgaggagugacaggcucucaccgucagcuauuggaaagcccauggguggcaguaacauguuacgaaguccuaauacucaugugugugcaugugggcaugggcguauguaugugcagugcaggugcucgagcaugucucucugugugugcauguauguguguguguuaugucagagguggguguugacauaaggaucuuaaucuucucacuucuccugacucucucuccauuguuagggauacucacagacguagcccaccauacacaguugucugugauacugggaacugagugacuuccugcaugucgggcaggcgcucuaccagcugagcuccacccucaccccucaccccagcaccuguuucacauucaagaagaaauccagagacacacguggaacagagucaagcagcggacacaaaugcaagggcucagcgacaucucaguucccucagcucagcucagcucagcgucaaacacuugaaagcuaccuggguugaagcuaccuggcuauuccccacggcuggcaacccuccccugugccacauuaaagagacccugaaugcuggcauuuaccacucuucuuuugugguccuugagcuucccugaauccuuaguuaggucuagucaagaaacuguguaaacuggcaugucucauucaaguuccuggcugcccuccaagaaccaggucacacugaccugguccuugccccagggacacacaagcugggacagacaaaagcaacuugccgccaggacgagcccacgggaauaugguucccaucuuccugcagugugguggauggaaggacuagggacuagauucagaacauccuacugaacacaggauugccuacgcccucgcccagacuccccuucgaggauccauuuagauuuuuccuggccauuugaacagguuucugggaaggaggccaagugauccaagacaaccuuuggcuccauuggaggaacugggucuucccuucugcaaacagaucaguacuucacauuuugauuugcagugcuggagaucaaauccagagugccgugcgugccagccaaauguucuuugacugaacuauauuuccagccuucugugcuuacaguauccagcaggauaaacaagacaaacugacaccacacacauauggcugcaaaccucacuuggcacacaaagcuagggcugugcacaggcaacggaaacagcuccauugaaaacggguugucagggagagauaguccaugccugaaaucccagcacuugggagguugaggcaguucaaggccuuugucaggcgcauugggagacugagaccugccugagcuuaaaaauaaaauagaauaaauacgaagcaaaacccaauagcaugauaacauuacaaacccuuuuuauguuacaacuagucuugauacauuauaaauguuuuaaaaguguggcuaaggggccagugaaaucacucagugacugaaauguuuacgugcaagcauagggaccugcaucccagcacccacauaaaggcccagcaugaggugcucaugugaaaccccagcuccauagaggggugggggccagagacaacauuacaaaauuacgauggagaaaaacugacaggacacuagcuaccaaccucuggccaacuacgugcagaagugcacaaggacaccagugcucacauguacauaugcacacaugcacacaugcacagaagaaaagaagaaaggagggggggaaggaaauuuaggaaugaccaugauaaacugggaguggcaggccaccucuaaucccaaguacuugguaggcagagccaggugcauuucugugaguucaaggcuagccugaucuacauagugaguuccaggaucaucaagacuacacagaaagauccugucccccccccaaaaaaaaaguaugauagaugcucaaaauuuaaaaguucuuaccaggggaccccaguuugauucccagauccucuguccuagcucacaacugccuucaucucucucucucucucucucucucucucucucucucuuucucucucucucucacacacacacgcaaauaaaaauaaaauaaauccuaaaaaagaagaaagaaagaaagaaagaaagaaagaaagaaagaaagagagagagagagagagaaagagagagagagaaagaaagagggagggagggagggaggaaggaaggaaggaaggaaggaaggaaggaaggaaggaaggaaggaaggaagagaugggcaugacgaggcacaucuguaauccagacauuuggaaggcuaaggcuggaggaucaugaguucaaagccagccuuggguacauaacacagccuuuugucaaaagccuaacauaaauaaaugaaugaacacgaaaagaaaaacauugcagaauuggcaauaugauugaucagaaaagcaaacuaauccuaagaguuugcaccugcaccugcuaucgguuucaaaauucauaagggaaacacuuacaaaaagcacuauacaaguagccaauugcauagucaugauaggauauuuugauaccucucuuuuaguaguugaugaaaucagcuaaaaaaaaaccaaaaacccaaaagcaaccaaccaaccaaacaaacaaaaaacccaauggccacaacaacaaccaaaaaaacccucuuucuaaauaaaaggaucauuagccuggcuagggaaugcuuucuggcaagcaugaagacccaaguuccaaguucaaugcccaggacgcacauuagagaauagcgccaucuccuaaaacuguucucuggcuuccacaugucuacaauggcuuacacgugucaugggcauguacacaggcaugcacaaacacacacaauaaauaaauaaacaaacaaacaaacaaacaaauaaauaucauuuuuaaaaaaucaaaagaucaaguucaaugguuuucaaagagucauuuacuuuuaaaggucccuuggugaauaccugagacccucagaaagggcucagaaauuucucucagaacaggagaauauuuuucauaaaguccuaagaccuuaauggccuugccaugguauuuuuuuuuugucuuuugcuuaauuuguuuguuuguuuguuuguuuguuuguuuguuuguuugagacaggguuucucuguguagcccuggcuguccuggaacucacucuguagaccaggcuggccuugaguucagaaauccaccugccucugccucccaagugcugggauuaaaggcgugcugcccagcuugaauuuuuuuuaacuugucaaauugcauaguauauggauaauauaccgacacagcaaaaacaaaauccguucaaaaacuuuugaauuuucuuacuguacaguaucaaugucauauacucuaaagacaaaaauuauugcaaauggaucuuggauuuuaacugauaauuguaugauugggaguaaaaauggcuuuuuaauuuucuuauuuuaaaauaauuuuuauuuuucuuuuugauaauuucacacacauauauaauauauguguucauauuuaccaugucauguuuuuugaguggggggugugguuucuuauguagcccaggcuaguuuuagauuccucacccucuugccgaaagccauuugccagugcugagauugagaagagaagcacuacuaggcccgggucgucugucuuuuuggcuuugaaacaguaucuaauuuagcccaggcuagguugaauuuucuguauagccaaggaugaccuugaacuucuaaaacuucucccuccaucacccaauuacuggaauuacaggcaugggucgccagguucaguuuaugcagauugaacccgggaccucuucacucuggccaagcaaucuaccaacugagcuacauccccagcaagagucuucuccugauaucuaacaaguguacaguggaacuuuccagaggcugcaagacauuaccacagauuugagagcaagacacagcuaucuuuuaucaaggcuagcaugaaagagauuugcaaauacagucaugcguugcuuaagaauguggauauauucugagaaugcaucguuaggggauuugucauuguguggauaucagaaaccuccacaagugagaugucauggcuuacuacauacuuaggcucugugguauguaacauuauagccauguuccaucgaugaccaacacauuguuguguauguaguacauggcuaccugaaagccacucuagcagggguggggguggugcacaccuuuaaucccagcucuugggagccagagacagcuuggucuacaagagcaaguuccaggacagccagagcuacagagagaaacccuauguggaaaaaccaaagggguuuggggagggccacuucuguuccacucaccaaauuuggcuuuggaaaaucuagaguuuuuuuuuuaaagaauuauuucuuuauuuuauguauaugaguacacgauagcugucuucagacacacaccagaagaggguaucggaucucauuacagaugguugugagccaccauguggguacugggaauugaacucaggaucucuggaagagcagacagugcucuuaaccacugagccaucuuuguagccccuuagaguaaauuuuuuuuuauucuccuuuuaugguuacaugguuaccaaauuccugcuuucuuuguuguuuaaggagacagccauagaaaucacauucuuuucaagcacacaagauguguucaucaagacagagcauauucugggccauaucaaaguuucaauaaagcuguaagcucugagaacauagagagcacauucucuaguucagguagaguucaauauaaagauaguaucaaggcuaguaaaagcacaacgucaaaauauagcagacagaugggaaucagacaaugcauuucuaaacaagacacaggugaagggauuaaucaugagagagauuagaaauauuucaaagaaagguaugauuacacauagcauuucaaagcacaggguacuauaaaacaguuuguagaggaagauuuauaucuuugaaaaauauacauagagagagcaaaaaauuuacucuuuccaugccuuaacucuccguauucaggagggcaagggcagguggaucuuugugaguucgaauccagccuggucuacauacugaguucuaggucugccaaggcuacauagcaagaucuugccucaacaaaauaaaaaucacucuuucuucuuacaguuucugugacagauauaauauuuuauguagauacguauauauauacauauauauauauauauauauguuguugaguuuugauuaugcauuuauaucccucaauacauaggaaaguacuaaaaucccuagcuaagucucuaccccugggaaacaguuguuucuuuccccacacuguuacuguaacagccagugacauacuauagagcuaggagauagcagaaaaauuucagucacccugccucuaggaccagguccccuuagagucucaaguagagggaaggcuggucaauuaguucuaucucagcccacucaaccagccgacuccaugucaagugcucccucugguuguggcacgcuugauccauaucuuuuuguuugcucacacuucacugacugcccgagucuagggggagacucuugguaucgaagauaacagggguuuaugaccuaucucuaguuaagaucugguucugcaauuuacagucauccuaggccaaguucuuugcucucuuuaaaguuccuuuuaaaacaaagacaucaagcucugcccucugcagguuccaugugagguugcuuuucaugaugcaugugacgggcuaagggcuuuagcucagcaccuggaccacggcagaggcuugaagccccuggaagccccgaugauucuuacuagguuuuggacagagugcccagggauggugagccuccucuucugcuggagaucacagaauguuucucccucccaccuacaggauguucacggcauccuggauccuguuucaggccucaccuuggauccgcaggcucuccugguacuggaugaugaaguacucuugggucugcugcagcuucuucagcucguucuccguguccugugugaucaggcgcagcuccucaaaccuuugguugaucugaaggugcuucugggacauggcgucaaccaggacaccagcaggggagcugcacuggggacacaauaggaugagugagccgggugggcagugguggugcacacuugggaggcagaggcaggcggaucucuguggguuccaagacagccagggcuaugcagagaaaaccugucucggaaaaaaaacaaacaaaguaaaaaaagcaaauaaccaaauaaagauagacucaaggaaagggacaggagcugugugccaggcaguaaggaggggaccaacaccagacaccucaaacuccaaaucugggauuagaagggagggcuaaaggauagucagugacagaguuggagcagaaaggaaaaggagaaguuaaacagggggccugggaaauaauggagagucugcggcggaaaugucuugugucugaucugguuuacacuagagaauauggagaguccaucaaaucuccuauagagaaauuaggaggggacacauggcaggcaucacaugaucucucuaaggaugcucuuccuaaggaugaucaauucauucccucaacuccauaguuaucaguugaugcaauggcacugacugcgcuaagugcugggggcaaguaagagacagagucuauacacauucacagccucugaguccucacaccuggagggacagagaaagaggcaaaccugucacggggggggggggcauccuggagaccucugagauaaagugacagggagagacaucaccaaugucccuuugaauuuugccaagccuacggcaucugguugagagacaaccguguguucagggacuuuccaacaaaguguucucaaaauaaaauccaaacuccuuggcccggcuuuagccagccuggcagguggccucugugucgucccagcuugccuguugccaacgcgcagcagguaugugugcuuuucugcaucuguuccuucaaccucgaaugugccugccccagggcccuugcacuugguauggcaccagccugcaguguucugcuggcagaucguccugagacagucacuucaaccccauuuuguagacacagaguuuuucaaccuaggugacgucuuuugugugcuuucuaggugguucugcaaucucaacaacucagggaugcaggaacugggcugggaaauucagugccuggcucuugagucuguguccacuguggcaccccacuugguccucuugccguguuaaccgcuuacaagucuucaaccccuaagguauuaccaacaucuuccuacuccaaagugcacuguuguuauuuuaggauacgaaagugauccuucauccuugcuccuuccugccucugcccccucaggacacacuccugccagcugcccugugucugucucccuacaacucagcucacucugaguccugucuuugcugggacuccuaggcauaggcugcucuguuuuaaguauuuauuuuauuuuaaagauuuauuuagugcgugugcacacguguaaaaccuucucuucugucuugcaaugcggcuguccauacucagcaugcauacaaauucauuuaauccucauggcaaccuuaucaggaaagcacgauugcuagagccaguugacgacagugaggacuggggacgaauugguagcucuaucuugcuuagcucuaccuauugggucgucauuagaaggcaggaaaggaagaaggaagaaaagaaaggaaaagaugaaagggaagcuguggagagauggcucagcgugaagaacauguauauuguucuugcagaggacccaaauuuaguucccagcacccauagauaggcaccucagaacuaccuguagcuccaggggucccgauggcccuaguuuccaaggccacuugcacaugagguuaaaaaguuaaaaguaagauaacuuauuuuugagaaaggcagagaaagggaaggaaaugaaagaaaagaagaauuagaggcuuuagagagccagggauggagccagggacugggccgacgagucacucuguccuguccacagcgugacauacacugccucucacaccugccccuguccuuuauuucuccugugcucuccauuacauaaacacggugggaucuagagaggaagucauaugaaggccuccccagcuccucuccccaugccuacagacagacacucacauuguuggcuucgcgaaccagccucuguucguuguacagaaugugacggauacagcgaaccagcuccaugggacagcggucauacguguucugaaagaggacacaagaaccaccaauagccaccuaguucugaucccacuggcuuccuugcggcacucacuucuucuucuccccuaagccucagcuuuuccugggaagcccuuaggauuaucagacaccuucacucuccucugccccuccacuuccagaacuucuuaccagguuuauagcgacuuagaaacucagagucuaaacacaaagugcuuccaaccucacaccagccuuuacucucuugagcauggaaauccuacgacaaaaacucaaacuguucucaagucauggaugggaaaauugauguucagauagucuaggcauguguucuggggcaaaugaggaagacagacagacagacaggcaggcaggcaggcagacagacagacaaagacagagagacagacagagagacagacagagacagagagacacagagacagacacacagagagauagagacagaaagagagagagacgcagagacagacagagacaacagagacagacacaagagacagacagagacaugcgaggccagcaucaaggugcuuuccacuaggcaccuggcccuggguuccuauuuugcuucgucuccuguucuuucugcuucuuccucucucuaggaugagguuucacucccccuacaucccacuguuuggagguaagagggguucucuaagaaauacaaguggguucugauaaaugcuugaccauaaaugccacccacacccuuuuccugauuccauaaaaaucccugcuccccuccauauauaggggagguuccuuuuuuuauuucaaagcccuuuuauccagcucuugcuccacggcgagucugauucucuucagcagcugucaugauuuuaaaugagccccaaggggacugucugcuugccuuauucccucguuucuagacugccaggguucccuuguccuggggagguguccaccugacucaagagggcucucuacuguuagaucuauccacagugcugcuacaccgccccgccuugcuggaaacaccccucuccucccuccccaccccuucccaccucuugcuuuguaauauguuaaaagaucuaacaggucugacuuagaaagagggggugggggaaguugaagaaaaguugccaguaagcuuuuggucacauggugacucaguggccaggccaguaaaaaucccagggguucugaugcugggagagagcuuaagggggccccuuccugcagaaggcaaaagcauucacacccaccuggagcuguguggcauagugccccagcuugaucuucagcaaaaacccaucuucccccaccuggugcuccgccuucuucugcagcuccugcaccaggcccuccaggaguuggguggccugaccucgguccuggggauuauccaagucaauagcaucccuuggaacauaaaaagaggggagauaaagcaucaagagugauucagggcaucccagucccacaagacuugcucaccacagcuguauaagcaucaaagucuagaugagucuccccucugauagcuccaguuucccucuuccccuuucccagagacaccaccccuuccgcacaaggacagauagaaccagagucauaccaaaccacaagaggagacccuuggccuggaggugaagacucaggguauggggcaccuaccacggcuggcucucgauccacugggccagguagugccggaccucgauggggaaaugcugcccauacaacacuugcaucuggcgcagggcaucucccugaagcugcugggccugaauccagcccgccauggcuguuuaccugggggagaagauaagucauuuguuccacagaagucucuagccugccaaugcccugcagugccacgaaaggaccuaaggacugaggugaggccaggcuccucucucaccccaggcacgcuuuccugugugggaagagagauggccacccuucccuuccaacaaggaacccucgaggcugcccuucucucuuccugucccuucacuccaugucccuucgcucgauggagcuauccccagacuaaauaaaaaaaggggggucuacaaaccgaaagagaaacuuaagacacagaggcccacagucccuaacuagacaaacacaaaaauucuugccacccagccuaagacccacacucaauuucuuggaagggagacuguuccaaccuaaaaguuaggccaaugcugggacagccacuggaggugcaggucuccccaggcacgugucuggggcugucagggagagaagacuaaggguccacgcugucuucggggaagcccugggcugcacuccagaaucuacccgcuccgaguggagugugauaaugucaguguccacugcgugaguccaccccuggcugccgccugcacggaucccuugucccugcucccucugaagcucccauucgaaggcgggacagaugucugucccgugucaggccguggggacuccagggugcuagaucccagggacguggcugcagccuagauccucuguccacgcgccgcgggcggagucacggcgacccacccaccuggugcugcggagcgccugcggcugucgcuccaggccggggcuucugacggcuccugacggcucuugacggcggcggcgguggaggcuguuacuacaggaaggagcagagagcagcgauuuccuccucaaaggucagcugccuccgauagaccaaacacagcgcgcgagcucgccccagcaccccucccagcagcggucgcucccuccuugccuccgcccucgauuaccggcgccccggcgagugcgccagggcgccccgcuuacaagaccgaccacuaggcugggcggcgcugggcugaggacagccccuacagcggggugcccccucccuacacacacacugggacucccggucugugcuccccugcggcuccggggguggguggguggggaaugagggaggagcguccugggacagcugaacuggagcagccagagggugccgggaagucccaaacucugaaaaucccuaacuagggccucaguuuuaucaucuguuaaaaauaaauaaauaaaauaaaagagggggaggaagaaaagaaaaaaaaaucuaccuagagauggcuccuaccucuggagucaacuagucugucucuagauuuacaaaguuuuguguguguguguguguguguguacacgcgcauguucagguaagggugcauguggcuucuaugccugcagagucaaaacuuuagaaggacuggcgaucccagagaagccaagccuacuucuaaggucucccaccuagcaugacuuccaccacaugaccuucccccuuaaagccgagcaagaaagaccuugguaaucauagguuucaaccccccacacccccuucugaccuuugcagguaagaaacgucaauccagagaagagaaggggccugcccaggaccucacuguggucacaucacagucucaucaucagacugugacccacaaaccacucgggaguccauccagugaccuagaagggucacaccugaagcugguccuaccuucuaaacaggcgcaggaagggguagccggcacuuucuaacuucacaucugccugcagacuuugccgggcagcagaccugcucccuggagcuuugccuggaucauaguccccaucccgaagaguuccccucaaggcccagggguuggacaaggccaggcuggaagucugccauccccu

SEQ ID NO: 12489 - RNA, 29089 nt, Mus musculus
ccgccauguuagauucaccccgcagggauagcaggcgagcuggccgcgaacgguccuugcacuggccacuggcaagcgccccccgugggcggaaagcugguaaggaagcuaccacuguuaccuagaaguaggggcacgccguucuuagagugcucggggaaguucaaggggaaaaucuugcaaagaggagugacuuuccguguucaggggcagccagucuuuucagugaccagaugagggagucgcuuggguugucaucgauagugggggguggauacugccugagggagacaguucauggcuuagaagggccaguuucugcuaagaaaaggucucgaucccccccagaacauaaagagggcuucgaugguggugacacucacuguccuggggacauggaguuccgggaaaccauuacuggaagacugggauuaagucugcgacaagaaaggacauacaucuuccucauucugucccuuuccuauuuuuaaggcucuauugaaggaagauaucuugagcuaggaccuuccaaauuagaaaggcaucguuuuucccguuaugucaaacacccaccuuucagaugacacauuuuaaaacucagguugcuugugccagcuucugguauagaaaaugaaguucagauucccaaauuggcuuuauuaaaauuauuugucgggguugaaaaauaaucacgugaggaaaagcugacuuagccacaugaacgugagucaauagguaugaguuuacagugccauuuaggaaagugcaggcuuaggcccagcuaccugacugcuggagguaaaccuucagguauagaugugguuaacuguacuuuugauauuuucacaaguucaagaugauugcucuggcugaaagaauuuucacacguaagcccuuuaugaagaccuguauauuggccagcuaaacuagaaccgccuacuuccuguuuucucccaugggcagaacagcugguugcuccaaaguauggaaacuaauucccacuuguguaauuucagaacggggaagaauaguuuccuuccagacagaaaagaguggaagaguauuucuugaaguuggaaaguguguuucacaauuuuuacauuuuggucacuuuguuuuucugguuuaaagaaaaaacaaacaaaccaaccaacuugaacgugcuggggaguugcuggggaguugaugagccagcgucugccuaaauuuuacagcuccuaagaaggaagaauugcauuucagguaaaugcaugcugguugucagcagggugggugcuagagauuagcauuagcuuggcaucgaagucaauucuagauaaagacaagugaugggaaaaaaugaauaauugaguauauaaaauagucagaauuaagaauacaagguucuuuuguuucaauuauuuauuuugaaaccguugguguuuuuguaugucuguaggaggguguuagauuccccuggaauuggaauuacagacaguuggaagcugcugcacgggugcugggaauugaacuggguucuuugggggggucggggggggggggaggcugagccaucucuccagcccuacaggcucuuaaaaugacaguuguauccauaguacaacacucugaaggcagaagcaggcaaaucuauagcaauugccaggccagcaugggcugcggagugagaguaugucuccuucaaaaauuaguaaauaauaaacuagaagcuaucuuagugaaauaaagaauuguuucuguugauaagaauuuauacacuuuguggugcuagaaaugaaccccacagcuaugcacauaauugacugguucggccuuauucccaaucuccuaggccauaauuuuauuaaauuccuuugguaacacuguuaaggucaucaaaauaguauuguuuuuauagauuaaacaguugaagcucagagauaguguuucucacagcucuaugacuagucugugguggaacugugucuggaacccugagucuucccgccccauggccucccuuccugugacauuggaaaagucuaggacuuaaucuuguuugccucuuguguguggagcagaaucuggcccuuucuagaugcagauuuaaaaaugugcugaauauuuuaagaggugaccuuuuuuuuuuuaaugccagugaguuuacuuguagcguuaaacaacuuaaacuaccuuuuccccuaaagucacagaucaucaguaagcaaaguccuucauuaaagucaaaccgacuuuaauaauagauaagugauuaaagaauuaccagcuucuuaggugugauaaugguggguuuuacauuuuuuuucucauaaauauuuacgaaugaaaggaugaauauuuugucaagagagacauugucaugagacaaggguguagcucagugguagagugauucccuaucgucuagacaucuguauuccauuugcagccccccacacacaacugaaaggaaggaauacuggauaacuaaauuagcucccaguuggauauuguggaagcuagcugauagguccaaaaggacucagcaaguuccuuucuuuacuuuuauauaccuuuaaaauuccccauaagugauuguaagagguucugguagauuguuguuguuguugcugcuuuguuuugguguugguuuguuugcuugcuuauuuucuggagacuuaguguucauucuguaacccaggcuauucuugaccuccuuaccuaaaauuggaaauuccgucuauuuguacuccccaaggcagagcccuugucuguguuaauccaccuugcuggauuacgcuacagaugcucaacuauccaagcacugaaauaggcagugaaaaaucuuagagaccuaaaacaugugaaggggguuuuuguugauguggauaaaauuuaaacucguucaacagccguuuacccuccccacagcccaccucuuuaauccuaaagauaggaucucauuguuuccuaggcugaccuagaacucuuggacuuccauuaccauccugcaucaacuucugaguaacugggacuacaggugugugcccaacuuggcuuuucucucuaacauagaaguucuauauaagugguagcuauaacauaagugcagaucuuuauagcaguaucuugagcauuagugucuuuauuuuugagaaggaaaaauccuguguaacagugagauuuguagaaaacacauuacuagauaguaaugucaucauggggacauugucugucuuauucacuaugaucuuccaagucuaacuuauauaucagagcugaagccuccggguggguuuuuaaucccuuccucuuccuuucaucuaccuguccucucagcuccagccagacagcauggaaccacagguuacucuaaaugugacuuuuaaaaaugaaacucaaagcuuucugguuucggauccagaaaauacaaccugggcugauguugaagcuaugguaaguaccgcuuuguucuguuucucaguggguuauacacagauauuuuucaaaauguagcuauuuugagcaguuuauuuuauccauuucuggaccuuuuggaaaaucauuuuuuacagggauuugguauuaguagagaauauguacaaggaaaaaggaagaaacaauuauguuccuuuaaacaucuuuaaaauuacauauauuaauuuuuuugagagagagcaaaaaucugggacaauuuugggaguugguucucucuuguaugagguaaaaugauauuuucagugaauuaggguuuagagacauucuggggauaaguuaggcuguccuucccugcagccaggccguaguggguguugucugacuggagagcaggcgcacugcuguguuuguuaccugacgaggaugggauuuguguuuugcaagaccggucaguugcuuuaucgcugggucaaagguuggaugucucagagcuggcagaaagcagcgcagcucccaugggugcccaugcagcagcuccucugcuccgugcuuugguuuagugucuuucaucuugcuuugcccuuuguacucuucugguuuguggguugccauggucaauguuuuccuacuugggcaucuguguuuaauguaaccauuuuugguuacaaauauuucuuuaccugguuuaucuauguggguaacuucagcaggaaggacauuuuagaaaggggccuuccaguguguuacagucguucccugucuuccagcaguuucucuccauccugcccuaggcagguggcuauugaggaagcagugggguccuguuaaaugaucugagcaccagauuucuuucuuucucuagcagcuguugggugaguuggcagcuugcccuuuuuuuuuuuuuuuuauuggaacuuguuuuguuuuguuuuguuuuguuucgcuugaguagcccuggcuguccuggaacucacucuguagaccaggcuggccuagaacucagaaauccaccugccucugccucccaagugcugagauuaaaggugugcaucaccuugccuggcuggaauuuuuuuuuuuucuuuuuuuaagauuuauuuuauguaugugaguacacugucgcugucuucagacacaccagaagagggcaucagauuucauugaaaaugauuguuagccaccaugugguugcugggaauugaacucaggaccucuggaagagcagucagugcucuuaaccacugagccaucucuccagcccggaaauuuuuaaauuauauccuacaugugcaguucacgucuucuuuaaauagccagagaaaacagcccgaggaacuucccacauuuccauguucaugcgguuaucugguagggucauacagucuucuacaucuugcuuuucuugcccaacaguauauuguagcugugguuccucgucaguagacacagcaaucuuagucuuuuacagcugaguccacgguguucuuaguauugcuggacgauguggauaggaccauuacuuacugauuuccccaccaagguuuucuuucuuuucccauuauaaaauagacaggaccuacaucucaguaugaguaacuuaugugugguucuauagaguagagucuauccaaagguugugugugugugugugugugugugugugugugugugugugugugugugagagagagacagauagggacuggagagauggcccagugauuaagaacacuggcagcucuuccagaggacccuguuggauuuccagcacccagguggcagcucaccgcucgcuaucuguaacugcagucucagaacgucagccauccuccucuuuccuuugcaggcagcgcacucaugugaugcacaggcauaugugaaggcaaacacucagaugcaucaaaugaaaagcauuuucauagauagugccaagugguccacagaauaauuauaacaaugcacagaaaaaaugacucaaugccuagaaggguguucuguuuuuuauuuuguggggccggaggucaaauguuggaccuucuacaugcuggacaaacauucugccacuaaguuuuguuccuugcccugaaccuuugacaacacugaauauuacaacuucaaaaaauauucaugaccaggcguggugcugcacaccucuagucccaguauuuaggagacagaggcaggcucugucuuagacucugugagucuaaggccagccugaucuacaaagugaauuccaagucagccagagcuguugaacagagaaacagccaugucucaaaaaaaaaaaaaauguucacaucuuaauaaugugucagaugugucucuguuuacacuguuuggcuagagguaagguugaauauguuuauauauuuauuaggcauuccuauuuccucuucuguauauuuugugcacauuuuuacuuguauuacucuguaagguuuuuguucguuuuuguaagucucucuggcuguucugaaacuuacucuguaguccaggcuggccucacacacacacacagacauccaccugccucagccugcugcaugcuggggauaaaagcuuaaggaugugcacagcugcacuggacacuggauuauuccuccugcuaucgguuuucaugaguguguguguguguguguguguguguguguguguguguguguuuuacaaguuuuaccccuuuaucuguuaacucuuacagauguuuucucuuagucuguuuuaaguuauuuuuaaaaacuauauuaagguguuauguacguuggugaagggcucaguuagcauuuccaaagcucugcauugaauccccagcaucacagaaaaaaaugaacauaaggggcuagggagagggcuccuuggguuaagcccuugccacacaggugugagcaccaguguuuggauucccagcacccauacaaauguaaguguguguuauggccuguccauagagggcauccugggagcaaauuggcuggcuagccagauuggggagcucuugguucaagagguuuugccucaauauguaaguuggagauucaugggcugcuaucugcaggcugcaagaguggucuuggaaaggcccacaaguuuaccacacuacugguggcuuaggcagaauacucuccggcuccaccauuacugcuaaugcauguaauguuuggaaaguucauauucaauaaaagaaagucaaaaugauucaucuuauauagugagauacacugagccaauuguuucauuugcagguaaaaguuucauuugaucugaauacuauccagauaaaauaccuggaugaggagaacgaggagguaaagugucugaacgccauuguuagagauuuacaacaggggccuuuucuaaagugcuaaggagcuuaaaguucagaauaaagcccauuuuaguggcuuacaccugucuuuccaguacuugggaaguuuaacccaaccuggacuuuaaaacaaaagacugucucagagacccauagggagguggggggggggggacgaaagaaaaaaguucauaguaguuuaaucucauuugccuaguaguuuaaauguauuugcuaguugcauacuucaugaagacuaugggcagggaggcaggggcagauggaucucugaggccagccuggucuacagaacaaguuccaggacagccagggcuacacagagaaacccugucucaaaacagcaacaauaauaacuauuggcaucugagcuggaguugagaaaugggaaagcaacaugaagacuaucagagaaagaaccuacaauuauagcaagacuugacauuuaguuuaugaugaugguggagcuaaaugggaacccuuuaugaagugguuaaagugcgcuagacuagcaguacuguauaucugguaugucgucaucuuuauuuucccuuaaggaagcagaaguucugagagguuagaaagcuugcccaaaggcacaaaaguacugaaguagggggcccagauccugggcuccuagcccuacacuaugcuacguguuaauaccacuaagauaaaacagagcacauuauuuaagcaguaguaggaauacugaccaccugaccugggaauuugcuaagagaccgauccuagucaacaaaaugcucaggugaugagacuuagaauucacuguugcuuuuuuucucuucauagauauccaucaauagucaagguaaguuccugagaaaaaccuuguuagcuuuacuuaauauuugccugacaugacaucuuuaaaguccaguacugaggaggcugaggcaaggaggauccuugguuuaaaggcacucuggacuucauagugaaacccuguuucaaaacaaauuaaucuguccgaugagauguuuccguuuaaaccaugcuuugcucuaacauacguuuuagaauagaauuugguauacuguaaacugaaguuguacccagucaucaucuguagcauuaguuuuguaggagagucuuuuuuucuuauugaggcagggucucaggguaucuucggcuuacuucucacucaguguguagccuaggaugaccuggaaccuccagcuccugaguacuggauuacaggcuuaugcuuccacccccacgauaggcaguacugggaaucagacuuagugccuggugcuuucuaggcaagcacucuaccagcccagcuacauccucagccucacaggggacuuuuauuguauaccaauguuuuuaauagaagauaguacauuuguaugggucauaaggacaggucuuauccaacaugguauuuaagaugcugaucuucuaaaaaugauacacugcuaguuugucacaugcaacucguucugcugguauugcauuuguuuuugaccuggcauauaugugaauaucaaugcacaggcaagucauguccguguuuaucaggcaguugguuguaguccauauuguaguccccacauccuuaugugaaccagguaaaaugauagucuuaacacaguccaggaaguucacugaaucuuaggcuucacaaagcauagucagaagauuuggguugauauuuugugcuuagaaggcuagagcagcacagagggacuugagaggaagaugcuauguaguagcuucucuugucacuggauugcguugcaauaacuuuuccagaggagaugccacaccaagugggcaccaacaacagaucaaaguauaaucucaccaaaguccaacuugguggaagcagugaguuuguugggcuuucuugcagagcagaguuauauguacaagagugugggaggacgcaaacagcuagaucacugcaagaucccaccccaucguauuuugcaaucuuaccuuaucauagagaccugcuuuuagccauccuucaauucuauaaauaggcuaucaucucucaagaccucuugcagcuagagaaaggaguggaaucucaggcaagggucuucugacaccccaguggaguaacaauagcuccauugccagaguccuggcuaacacugugcucugguugucauagcuauaggggaagaggccaggaaugaaaucuuauuaugaccagaaggaagagcaccauauaauaauaagggaguccauauaugaagauucuaagaauuugaauaggauuuuaagaauaaauuauauauuuuuaaggaguuuaacauugauauaaaauauauacagguggcuuuaaaagguuacuuggggggauaaacuauguaucauuucacaguugccacccuacacacccugccucugccacuucaggguaaaaguagcugucauguauagcaagaguuuucaauacaauacaucaguauuaacuauagucuuuguuuuacacuggaacuauaggauuagccaaguauggugugacccuucuguaaucccaacacacaaaggauuguaaguuugacauuauccugagcuacauagcuagacucuuccacacccucaaaaagcaaaaaacuguagggcagaugauauucaguguaauuuguaaaacuagucaaaaaaaaugacuuuuguuuuguuuuugucccuuuaggugaauaugaagaagcacuuaagguaauguuuacuucauauuauuuucaaguaauuugaaaaauacuuauugaaaccuaaacuccccuggaaaguacuaagaauagaaugacucccguuaguuagagagucugugguaaguagggcaaaugacucagcagcaggcaguuccugcuacaguucaggugaugugucaucucacugcgggacuuaaugccaccaucuuaaaaagaagccucagggguuaagaguacuagcugaucuucuagguucuaaguucaauucccagccaccacauaaccacaugguggcguggcucacaaccaucuguaaugggaucugaugcccucuuguggcauucgguguacaugcagguagaacacucauacauaaaauaaaagaggaaaaaaagaaagcagcagcagccccggacauggugguucacuucuguaauuccagcacucuggaggccaaagugccuggaucauugaguucaaagacagauuaggcuguguaauaggaucguuugagccuaguuuagggauaaccugggcaacauaauaaaacccaguuucaaauaaaauauauuguguacaggaaauuuuaggugauuuuuuuuuccucuuuugcaaugaugcgcucagccccucaugcaugcucuacaagugcucauaucccaccuaacaggacucucaggcugagguaaaggaaaacagcuaugaggcagaggggcuggacucuuagcuguucagucccuaauuuuucuuaaacauuuuauuuauuuauuuauuuauuuauuuauuuauuuauugguuugguuuuucgagacaggguuucucuguguagcccuggcuguccuagaacucacuuuguagaccaggcugaccccgaacucagaaaucugccugccucugccucccgagugcugggauuaaaggugugcgccaccacgcccaguuucuuaaaccuuuauauaccuucauggaaaccaaacagcguauugggguuuccauaauacuuuauuaagaagauguucuucacaaagauacaacuauuugagcucgcucucuaagaccccaggguagggaaagugagugcuuagcuauagggaaaagcuuuaaguagccaugauuacuaucagucuggaauuaauuuguuuuuuagaaaguugagauuagcauuaaugucuuacagagaaggcaguuaacagguaauacacaccucacucagagggugaagcaggaagaucuugaccuggaugccagccaggacaacccaggcgaccccaugucaaaacagaaaacaaaauaauuuaagaagagcccaguagauggcaaaaucucaccuaacaauuucuucacauuuuaacuuaaagcccuuuguaguuaauauucuugauaaacaucaggcuagauauuaauguagagguugacuaucuuuaucuaaaaugcuuggaaccagauaugcuucaauuuuuuaaaauuugauuuggggauauuuguacauucauaaugagaugucuuaggaaugggucccaaggcuaaauuugaaauuuauuuguuucauauacacuuuauauagccuaaagguaauuuucuauaguauccuuaguauacaguaugaucauaaaaugccaggugcuaauuuuuuccuuguggcaucacgucaguaccucaaagguuaaguuuaauuaagcaugccuagccuguucacuuagaaaugcaaacaaggagccgggugugguggcgcacaccuuuaaucccagcacucgggaggcagaggcaggcagauuucugaguucggggucagccuggucuacaaagugaguucaaggacagccagggcuacacagagaaacccugucucaaaaaaaaaaaaaaaaaaugcaaacaagggcuggugaaauggcucagcggguaagaguacugacuguucuuccaaagguccugaguucaaauccuagcaaccacauguuggcucacagccacauguaaugagaucugaugcccagugcauccgaagaccgcuacuuauguauaauaauaaauuaaaaaaaaaaaaagaaaagaaaugcaaacaaaaauaguuaacuauacuucuguauuuuggugcuuugacauuucauuuggaaaaggagaaucacaauuuuuuuauuuuauuuuauuauuuuuuuuuuaugguuuuucaagacaggguuucucuguguagcccuggcuguccuggagcucacuuuguagaccaggcuggccucgaacucagaaauacgccugucucugccucccaagucacaauguauuuuuauuuuguaacaugcucuuguaacacacuuuuagauggcuaacauuaagcaaggaaaucagcuacagaugcaaguccacgaaggguaccauguuguagaugaagcacuccccaaaaaugugguagaaaaccaagcggcugccaggacagggaagaagccacuugcacauuauucuucacuggugagagucuugggaucagacaugaagaccacagaggagccugcaccagagguaugaagaggaugggccuaucugaccaacucugacccuacaucucauugucucuccuauaacauucgaauggucaucaaagauuugggcaaagaggcuggggaaauagcuuugaaagcacaagacugugaguuugauccccagaacccauguuaaaaaagcaaaaagcuggaaagaugacuuacuggguaaagaccuguuguguaagcaugaguacgugaguucaaauccccgcaauucacaggcauagugucauguugcaacccugaugugucuguaaucccagugcuccuauggcaagauggaaagagagacaggaggaucucugaaagcugacccgccagcuaccuuggcaugugcaguaguaaacaguagaaaagggcucuguugcacacaagguggaaggcaagaaccaacacccagugcuguccucugauugccacauaugugcccaaacucacauaaaagccaugugucauacauguguaaucucaggacugaagaagcagaggcaggaggauccuugggacuuacagccuaguuggcuguuccaagccagugaaugagucagccucagaaagauuuuuuuuuaaaggugccugaggaauaacacuuaagguuuugcagccuccacgugcacacacuguacacucacguauaaagauuuggcuguuuuugaaacuagcagccuugauuuacuucaagagaaagggaagaaacuagaauacacauuuugauuuguauucuuucacaaaaaaaaaacaaaaacaaaaacaaaaaaaccccacacaugucacaugcuuuugacauuugauuaaagaaauaauacauuuuagaaaaauuuagaaaaaguaacuucucuuguauuuucucccagcaauguucuucugcuccuugugacacagaccagccucaagacaagcccccagauugguuuacaagcuaccuggagauggugaguguccucucugaccuggguguuagcagcaguguuggcacagguagaaagcugaacccagaugacugcagccucuggugcaggggaguggcagcugugacuucugacauaaagcagauguagugaaggaaguucuaaccugccugaagcaucauaaaaguugacgauccaguucuacguaugugagggagacagacagagucugugcuucaaaaagacacaguaacagcauugucccaaggaagaaucagcuuccaugagaggaagagaccuauuacauuucugugcauuccuccagcagccauuagccauguucuugaguuaacaccagaaccaggaaaccagagcuauuucuucucacuuuuccuggugcuggaacugaguuuuccuaccuuguguucugcauuguaguuccgagaacaagugguuaaggaaacgguggagaaacuugaacagagguugcaggagaagcuuguccuccagaagccacuccugaguuccucacccacagaagucucaaugccuauuucagaggaaacccuguuuuugccagagaaccaguucagcuggcauauugcuuguagccacugccagaagaggaucguuggagugcgcuaccaguguagguaagcaguuccugggcaggggcagccaccaacuagcauucugggaaguuuaggggaagcuguacaucuucuuucuccagcauagguaauguagcuuugauuuacaagcacaggauaauagcgggaacuguugagagugcuauucagauacgcauuuggguuaacugaaucaggcagauuaaguucugucagucaaaauuaggucacuaaggauagacagccccccccacccuugccccguucaaaacguucuuguaucuuacuuguuucuauaaacuauuucauggaacuagguaugagagggaguuacuuuucucauuuuacaaugaagaacuuaaaccuuggcauagccaaguggcaauugaaaguuaccauccagggcuggugagauggcucaguggguaagagcacccgacugcucuuccgaagguccagaguucaaaucccagcaaccacaugguggcucacaaccauccguaacgagaucuggcgcccucuucuggagugucugaagacagcuacaauguacuuacauauaauaaauaaauaaaucuaaaaaaaaaaaaaaagaaaguuaccauccagcuggugauggagccaguauaaagcuuaaacugguucauugcucucuacuucagggacuucuugcugcauaguuuuuacuauguuggucuuuucacacagccuaugcccauccuacaacauuugugaagauugugaagcuggaccauacacccaugacacuaaccauguuuuguuaaagcugcggagaccuguugugauauccucugagccauuuuucuacuccaaguauuccgcuccucgucugccugcugcuuuggaacaagucagguaaagccacacgcuuguggcugcucauuuauuuggcuucuugacucugcugacacaaaguauuauuguugaaaauaucugagugggggcuggugagauggcucaguggguuagagcacccgacugcucuuccaaaggugcagaguucaaaucccagcaaccacaugguggcucacaaccauccguaacaagaucugacccccucuucuggagugucugaagacagcuacaauguacuuacauauaauaaauaaauaaauaaauaaaucuuuaaaaaaaaaaaaagaaaaagaaaauaucugagugggcugaagaggugucucaugguaagagcacaggcugcuuuuaccaaagaccuugguucacuucccaacaucuacuuuggcagcucacaacagucugaacuccaguuccaggcgaucugacacacguuucuggcuuuugugagcaucaggcacacguguacacucauacacaugaauuaaaaauaaauaaaucuaucuuaaaaaucuggcaagaugccuuuaauccuagcacucacaagacagaggcagccagaucucugugaguucgaggccaaccuguucugcagagcaaguuccaggacacaaaaagaaaccuuaucucaagagaaaaaaaaaaucagauguaauccccagcacucagaaccauccugagucuuagccaggcuaagcuauguagugagucagucucauagcaaaagaagagugcaaugguaguguauaguaucacaaaauuauuaauagucuccuuguuccuucucaauugauguguaaugaaacaauugucugagacucaucaaauggaaaugaugaguaugaaagaaauuaagaaaguagaugcugggcuggagagauggcucagauguuaagaguacucacugcucuuccaaagguccuaaguucaauuccuggcaaccacaugguggcucacaacuaucuguaaugggaucugaugccuucuucuggugugucuaaaggcagcaacaauguacucacauaacauaaauaaauaaaaucuuuuuuaaaaaaagaaaagaaaagaaagaaacuagaugcauuguugacaugauugcagugccaaauguuucaaggcauucauucauuaucccacaggcuccaaaaacagguggacaagaacuuugugaaagcagaaaagcaaagguugcgggcugagaagaaacagcggaaggcagaggucaaagagcuuaaaaagcagcuuaaacuccacaggaagauucauuuauggaauucaauccauggacuucagagucccaaguccccuuugggccgaccugagagcuugcugcagucuaacacccugauguaagugcaaggccagggcugggguguggcuucccauccagcucucugacacaggaauguuaacacccuuuguuuaccuauugugucuccuagcacccacuguuuuaagcuucccauugucuuccaagcugguucaggaguuauuuuagacacucagcuuugaugccucauucagaaagcaagaaacuaacaaggcuuagaacagggauaauucagacuuuucuggaggcagucuggcaggguuggaaccaagaagcaagucuccaguuauauuuaugaacacuuguaauuacccuauauuuauggacacuuauaaucacccuuuaggcagcguaucuuuguuuuaugaccuggaauuugaucuuguguguguguaugugugugugugugucuggacaugugugccuugacaugcuggugagauccauucucuucuucgaucuuuaugccuucugaggauugaucuuaggucucugagcuugcauggcaagcaccuuucccagcugagccuucucacaggcucaaccuaaacaguguuaguauuuaagucaaguguauuaguacacccuucucuguagucacaguguggcauguuuggaggccauuacaccaguagcaagugacuaagcaucugcaucucuguccaggcuuccuuugcagcccugugccccaguuaugccaacacucagugcagcauuuguggaugagaauuugccugaugggacucaucuucagccaggaaccaaguuuauuaaacacuggaggaugaaaaacacggggaaugugaaguggaacacagacacaaagguacguuuucccucugaggguuaagacgcggaugugcaauagcaaagggcgcaccugacaagcauccuccuguuccuuucagcucaaguucauguggggaaacuugacucuggcuucuacagagaagaaagauguuuugguucccugcuugaaggcuggccacguuggggucgugucuguggaguucaucgcuccaaccuuggaggggacauacacuucgcacuggcgucucucucacaaaggccagcaguuugggccucggguuuggugcaguaucauaguggauccuuuuccuuccucugagagcccugauaauguugaaggggacaggaucagcucaagcaaagcugacgauuucuccugugagcaagaggugagcacuugggccauuggcccaggcccagguuauuuccucagucauaggaaugucaggcuugugacacgugcuuauauuguaguccaugcacuucggaggcugaagcaagaauauugcaggcucaagacuaguucuugcuagggacugagagagggaccugaacguaaaagaacucacugguagcuuguuauucuugcagauuucccaacaguuuacuguuucugaauucccaucagugugucagaauauaguauaguuaacuucugaagagagagggucauuuggauggcaguuucagaaguuccugucugugauuaggcagauccagugcuuucaggccucuagacuggacugacaacauacagcauagcaaaaacaaacaaacaaaccagaaaacacacuuaggccaagaugacaagagaaagaggaagggaccagaccuaaggaucucauguaaggcuacaccugagaaacauucauugucuaguaaugcauugcuucuagagaagcuaaagcuaauauaagccuuuucuuugcuuaccugccugccugccugccugccugccugccugccuucuuuccuuccuuccuuccuuccuuccuuccuuccuuccuuccuuccuuccuuccuuccuuccuuuucaagacaagguuucucuguguagcucuggcuguccuagaacucagucuguugaccaggccucaaacuugauccacuugccccugccucccaagugugggaauuaaaggcaugcaccaccaccacaggcucuagggggcaggcuuuuaacaugggguuuauggguuuacuccucuauacauuauuaugcugguauuuggccuaguccucaagguguuuagugucguuaggguuccggugcaggcagucccagaggacuuuugucuguaauggugcuugcugcaccaggaaaagaaggguaaccugaccgggcgugguggcgcacgucuuuaaucccagcacuugggaggcagaggcaggcggauuucugaguucgaggccagccuggucuacaaagugaguuccaggacagccagggcuauacagagaaacccugucucaaaaagaaaggcaaccuggccugcugcuaaacuccugguagcguuucuccuuaacacucaucuccuagaguaucccugagcccaaagacaucuucaucugccuguugcuugcugcagucugucguuacuuuuuuguuaguggaacagacuguacuguuugaacuuagagcuaaccaguguuaauuuccugguuugggcuaacuguacuuucauuaaguuguagaggaugguaggugaaagaacaguaugugaacucuuuacuguuucugcagcuuuucuagacgucccaaauaaaauaaaaaauguaaauguagagguucugcuauguuuuuauuuuaggggugaccuugucagccuggugcuugagcucuguugagguccuaaaauauaucccgauuauuugucccuauaggaagcuuuucuucuagcugaagaagagauuccauugggugaggugacaaagcagacagaagggacaggagccagugccucacagaagacaagacgcgcugccagugaaagggagcuguacauuccaucuguggaccuccugacugcccagguaagcaguccgcgcucggagggacaagggcagagagagugaguccugacaaaugagcuuucaccuuguuacugagaaggugcuguagccuucaugguccuggggaguuagagaugggcaggcuggauccaguaucucaugaggauaagauggugcguggagcaaguuucuaaacuguuugcuucugagugugaagcucaggcuugugcuuccccauggcuucccuccaguggucuuguaagcuuagccugcuucacucaccugcccacugucucuucuccccugccaguuagaguuugagaacaccauguuccuguuuaacucuucuagucacuugguugaggggggacaugaauuuaaauagaauugaauccaggcaauguccaggagaccugaugguccauucaggaaagagcauggcucccacuugugcugcagacaccuuuauuuggccaucucuuuuucuaggaccugcuguccuuugagcugcuggauauaaacauuguccaagaauuggagagagugccacacaacaccccuguggguaagauugucacuucacucaucuuguuuagguguuggcauuacacggucucuucuuggucugcugugcagcgcuagaggacgaggaucccucccauuuugugacagugaaguuguacccauaguccaucuccuccuuucccugucgucugucagugccacaguacacguguguaagggcugccguacuguaaagggaccccuucuucauucccucccuuuguuccuuucuucauaguuuuguauauuggcuuugaccuuguaggccauguacuuguuugugacucagcuuugaugagccagagcuaguugcguuccuggugagcuagaaaaguucugaugacaugacagcugguggagcauauuuggguuuauuuuaacccugcaggaagcaagaaaccuacaaacugcugcuucuggacacuugacuguuuaugaugucaugcuuucucucgguugaugguuuuccugucuucauucuccagauaugacucccugcaugucuccucugccacaugacaguccuuuaauagagaagccaggcuuggggcagauacaggaagagagugaaggggcgggauuuaaagcaccuccugguaagggguuaaauaucuguaaagcacgugccuucccuuuccauccaccucuccucacacguccauuccucauuaccucuaccucagcaaaucgaugucccauggcaucccucgcucucuacgucucaugacagcaggggcagcucuucccccacccaggcuuaggaugcacugacuggugagagcucucagcucuucagacacuaaguacaggcaggcuuuguaugucuuucagauuccacuguaucagcaaagaggaaagcugagaccccugcuucggucgaagaaacagaagaagaccugagugggacccaauuuguaugugagacuguaauucgaucccuuaccuuggaugcugcuccagaccacaacccuccuugcaggcagagguccccacagagugagugucccuagauuccuugcugaggagggaggaagguuaaucuuggugggcuuuugacgaugcuggcacgcuuacuagagcaccgagaacaaagaagccacccuaacucguuucuguccucucucaggggaauuacagcuguauuccaccgagggacagcagccacuugugcugccuggauucugcagaaaggauucuuccuguaaguugacaggaugccucagcaaaagcuuccauuggcagcugagucuucuccuuucucgcaagggcagcaaucugaaaagugggagguaacacaagaaugccaggcuguccccagcauuaaguucuaccauaaaaaccccuuugcaguucuggagaguggauguggauggagaacuugucuuacaagcucggggagcucagcuccauguccagcacucaguaaaaccucagguguuguggcagacccugucucaaaaguaagguagauggacagacauuuauaaaugccuuuaaucccagaauuccuggugcagguguaggcacaucucucuuaaguuugaaggccagcuauguagugaaacaccauuucaaacaaaagaugugggaaugacuucuagggaacuacacccaguguuggccuccucucuggucuucagacagucucacuuaucuaccugcacacuugugcacuaacaugcacaagaccuucagaacagacugcuaguaucaaauugauagagccaguuccauaugucucaauaacuauccaaaaaaauucaguuucuagugaaucauaauaauaccaaauucgagccgggcgugguggugcacaccuuuaauccagcacucgggaggcagaggcaggcgaauuucugaguucaaggccagccuggucuacaaagugaguuccaggacagccagggcuacacagagaaacccugucuugaaaaaccaaaaaaaaacaaaaaaccaaauucaagggcuugggaagauagcucaguggguaacagcccuuacucuuuaaacgagaccugaguuucaauccucauuacccaccuaaaagccaaacacagcccuaucuuccuguaaccccagcaucagggaacugagacaaguagauccccagagcucacugccagccagcuuagccaaaauggccagcuuuaaguucagggagagccaugaggaagacacuugauguccucaucugaccuacaugcacacauucagguauaaucaguauauaucacacauaccaaaaaaaaaaugaaauuugaccugcauauaccuuuaaaugugauuuuccuauuuuugcuuaaagugaacaugcacaugaaugcuuuuuuuuuuguacauacaaauagaagaaagguguggagggauaaaccaguuauucauaguuacugcucugauaggaucuugaggccuuucuacccacuccuaagauuuaccaguguucucaucagacuuuaucacuucucuaagguaaaggaaagcaagcagacaacaugaagugcuuacgacgaguccuuuuucugccacugauagcuagccuacgaguuuguuuuuuuuaauuuaaaaauuuauuuauuauuauuauaaauaaguacacuguagcuguccccagauguaccagaagagggcgucagaucucauuacgggugguugugagcuaccaugugguugcugagauuugaacucaugaccuuuagaagagcagucagugcucuuaaccacugagccaucucauagccccccauagcuuaucaguucugauggagcuuuaucucagucuuaacuuucacaauaaaaagaaaaaaggacaguaggauucacagugcucauuggaagccuggcuguuugagcccacacaccuguuucuguugacuucccaucuauuuguuuuggcaucgucuugagacagaauacagucauggcucuagaaacagcccauuccucugguucuuuccacugugcccguugugcuagcucgugauccacggccucuucccucacggugguuacuuuuauuccuuagugaaauuugccuugccugaagaaggaccgcguggagaugagagggaggagauuguccacauuguugaggaagaagucguugaggaagaggaggaaguccaagaugaagaaguccaaagucagucuucugcuuccucugaagauuauaucaucauccuuccugagugcuuugauaccagccgcccccugggggacuccauguacagcucugcgcucucccagccaggccuggagcgaggggcugaaggcgaaccugggaucgagucugggcuggaaccaacugaggcuagagagagacucccagagagggagagccagccacaggagcagagcaucagcgacauccucacaaccucacagccucuggacacggugccucuaguccccgagguggcaggacuuccagcagcauuguccagguacugcucagcaccucagccccccuguucuccagagcuggaaugaccagcuucaucuccaaaccuuucuuuuucuauaaucuaaacuuaggugaauaaaaauuauacucagauuucucagcacuuguaaauuugagauuuaaacaaauguuuguuuuaguuacccuuacuucccugaacauagacugucuacugacuuuuuuauaaaaaaucuuuaaauacaaacaucucuggaugaucccuuuauguuuugauucuuaaguugaguaacuguaacaaaaaugugggugaagggcuggagagauggcucagcgguugagagcacugacugcucuuccagagguccugaguucaaauuccagcaaccacaugguggcucacaaccauccauaaugagaucugacgcccucuccuggugugucugaggacagcugcaguguacuuacauauaaugaauaaauauuuuuuuaaaaaaaugugggugaggauuugucagcuccaagguuugccuggugagugugagggccuguucagcagaaaagcucgaaucuuccaugugcugcucucacaggcagagauauguauuaaguaacuuacagauauauaccacgucuacuggagcugggucauugucucuacuauucguauagaaaaugugagagcccuaaauauaauaaagagugcucaggaagggagaggugaccugaaugaagccaguuucucuagcuggauuguggcuagagaggacaucagagaguggaacucaguccuucugaccuucacacugccagauucacacaugaugggaucagcagccacgcugcugcacucuccuagugcuuguggcuacucuucagcucaccuucacuguucucucuuucuaaaggagcgccccuuguggacagugugagucaucaggaguggauucaccaggaguggauucaccagcuaccaugcacgaaguucccccagccccugaugacaucagaggagguaagccaggcucucucccuugcuccuuuccaguggacggacaccagguaugaagaggcucuccguuucugagacccguggccuuguucacagacuuugccucucccucuuucuguaugccucccucaugcucuggguuuccacucuuuguuuguuuuuuguuuuuugagacaggguucucuguguagcccuggcuguccugaaacucacucuggucucgaacucagaaauccgccugccucugccuccugagugcugggguuaaaggcgugagccaccacgcccggccuggguuuccacucuuaagccuguugcagaccuugcagaggugggcacugugcugugcugggaagagcagccuuggaagccagccagcuccagcuccaguuuugcuuuuccucacagacuaaugcggcagcucagcugguuugugaugccuucaggacugcgcccuuauuuuaggucucaggacuguagaacugugaaggagucaggagguccccacucaaggucacuuccucuuccaaaaaaugcccaaccuaaaacucugcgaacuaacacaucaggguuacaggauuagaggguuauuuuucuacucaaugauguccccagcauuucuagacaauuugucuuccucugugacuuaaaucagccacagaccuuucuaaaacuuaaaagaggaaaagaaaggagaaaaaaacuaaagacacccccauuaacuugccgccugccuugauaauagcuugugggugcugcagcuaaccaacagcucuuuugcuuuuagagcccagaggcucaacaggacucgcaaacagcagacagaggagcugugaccacucaagguaacgaccuugugaagucucuucuugagaaacaggaagacaucccagcauugcuucugcuugaaugagccucugagagcagguggcgagcaccuuaaaugagcaccuuccaagcacaggaaggagcacccucauuccuccuuguucuuacgucugacacuuaugagcaccaccggcagagagcuaaagcucaugcuuaagugcaucacuuuuuagggauuacccugaaauccaccucaccuguaaugcccaagaagacaagcaggccaagccccaggugcaucuagcugguuuucuuacauaccgcugccucucuggucccugccgucucagaucagaauccagaaaaaucacauuuccuuugccagguuuucucugagauguacagacagauggcugauauccaggugugcccaugaccacauuaauuuucagcugggauggaaaacuggcguaguaacuagggugugcguuuccugcaguacucaggucuucugccagccgagccagagcccugcagcaaaccaagaucuguagcuaugaaaacauuucauucucucuuuuuacaucugauuuuuuuuuucuuuuaaggauaccuuauuuuucuuucgagauuaucacccacauuaucuuguaaggucauguuuuauuaggggagauaauuugguuuuccucuguaggcaccacaaugggagcagcauugcuggaggacuggugaagggggcuuugucuguugcugccucugcguacaaggcccuguuuucugggccaccagucacugcacaggucagugugugguuucuuuuccuuaacuucagcccccaagucaccagugcaaauggcaguccuucugucuggauuggcaauuaacauggcaaggacuauguguagacagucucuuuaaugaacacacagccugcccgccauuuccuaucauuuuaauuaauuaagcuacucugggaaaaacaggaaaagaaccuaagauuuguugaagacugcauguacaaaguugcuguucuacaacaacguaguggacauacuacgggauaauaagacacacauuccugucaaacaacuguagggaauuggcaaaguauauacauuuccaggacaggauaggacacugugcuagugcaucuccaccuacugggacugaggcucuugggaguuaguaucugaagcacaaagcaaguguaccccagaaaaguaaugcuggauaugauagcgcucaccuauauucccagcuacucaggaagcagaaaaauugcaaguucaaggccagccugggcuacauaguaaaaccuuuuuucaaaauaaaauuugagaauauaaaaccauaaaaagguacaaauguaguuuaguaacaguagaacucuugcuuagcacccuagguucaguuacaggucuugucuucuccuuuggagauagaguaguguagcuggaagaguugugagugagcggaugauggauugaucugaagaggagaaaagaccaacucuaagugcggggguuuuauucuaagacauagaaggggaggguuguuguguuguuauggguuuguuuguuugcuuuuggaacagagucucuacauaucucuggcugucacuguagagcaggcuagccuuaaacuuacaaauucaucugcuucugagagcugggacuaaaggcucuacaccuccauuaacaggaaagagauaggcgcgugaggaccugccggugauuuaagugauuagcaaaggagugcaaggauaaagcucaggcuuuagccuagguacucaguaucacgcaucucagugaauaaaggugcuugcugccaagccgugacacccggaguuccgaucccgggaaggagagaacugacucucacaaguuguccucuggcauucacaugagcaccccacacacaaacauacaguaaaaugcauaauaaacugggcguggcggcgcaagccuuuaaucccagcacuugggaggcagaggcagguggauuucugaguuugaggccagccuggucuacagagugaguuccaggacagccagggcuacacagagaaacccugucucaaaacuaaaaaaaaaaaaaaaagcauaauaaauacacccccaaguaaaacaaguuuauuacuugccaguuuucuuaauguugaauuuacaacuuauccagguuaaaaguaaagucaugcagcaugcaguuggcuguguacaccuccauuacagaggauggauuugaccugaggcugaaguuugagagucauuuacauacagguucuagcaggagcugugugauuggauaagauuauccaggaaaaauaaaaggcagaagcagccuuuuaaguaucaaagcaacaggauucuacuaaaacagaacuuagaagaaacagggccacugcugcaacuuggggagguuuauaagggaucaguagacagugcuaaaugcugcagagagcugugaccuaauggugaggaauuugacaauucaaguaugccuugcuagcuacgugggggaaggaagguaaauauuagucuacaugucuacacuaggcagaaggugguguuuauaaaagagacuuaagguuggcaagccuagcagugaaacauguuaucaguacaaaugagaggaaagauuucugagguaguaaugguaaagagaaaaaaaugugccagacgugaugguaccauccuuuaaucucagcacuugggaggcagauagaucucugugaguugggggggggggggggguuguuccuguaaacggguguuagcuuccucuuaaugagaucacuucuguuuugagaguaaaaagucaaaaagacugcccaaaauauaauuucacaagucuacgcccaucuuacuugcuaucuggugagguucugucucaagccauccucaggaagucucucuugcucauauuugcucauuaccacuauuuuauguuaaagucuucgaggcuucucgucaucuugcucuucaauuauuacuuggcugaagaaugggugguuuuguuuguuugggguuuuggauacaagggcucauucuguagccaaaccuauguucuuccuccaagcaggaaucgcaggugugagccacugugccugagcgcgcugcuuucagaaaguccucugaagcauccucugucacccucuccuucaguuacgcacacacauagucagcagcacugucaaccccauugacuuguuagggaaacaggaaaguugugcccuugcaucugaucacccaacacuuugaauaaggaggaaacacuaggaugacaguguaauacagauuugcaaagaagcaaauuauauagaaaaaugucuccuugucucugcacagcccaucguuucugaagaucagaccacagcccugauggcccaucucuuugaaaugggauucugcgacaggcagcugaaccuaaggcugcugagaaaacacaauuacaauauccugcagguugugacagagcuccuucaagugaauaacaacgacugguacagccaccgcuauugaggacugaccuuguauuaaauaacugccugccgcucagagguggucucucugcugucauugaguguggguggaagcccuugcuugcuuuuuaaucugaugaaucuaugucucugaauugucaaaacaguaccuguuacaguauuuuuuggagcaaaucaaaggccagaacuuaaauuuucacuguagaaaugggaugaaugguaggaagacaguuuucaacucagcuggacagaacucucgccgcuguaguccguggaagcgaguaacuuggacuuccuuagaucgcuuuuccuucugcuuguauugaaauugaguauuuuccuuugguucauguggauguuuuuaaugggcuguuaaauauuaguuugguuuuuguuuuuuaaagauuaaccuugaauguuuccaagaauuauucaccuaguuucuauaaccaaucgcaagccucauagcuacauaaagacagcagaucaagaaagucauguuccucaaagacuuagaaaugaggaacacuuugcuuucagaaggccuagcaggaaccuggaaggacaggaggcauucggguuaacccacagcacccacugagcagugucugucaaaguaauuuugcauaaauuuuauuuaaggagaauccuggguagugugaaauauuuugcuaauccuauggggggggcaccuguuacagaaagggaaaguuaguagucguccuuuuacugacugucacaguggauuggaaggacaagcaugugcaaauacucaucucaguaaggucgggugugggugaaaggacacagaacugcugcugacuuuccgaauguguggaauccccuugugagguauccagcccuagaaagccgagaacaggaaguaaugcuuuggggcuaacccacagaaagguuaguuuaccauuagaauagaugggaagaaggcucugucaagaguucuaggucucauuuaguuuauaaagggaagcuuuggguccagauggugaaagaaaaggcaacacaacacuaaagauuuuauucauguuugagaaaagguaucugaacuccagcucaaaggggauaguuaaaauaguauuauuuaacuuaguugguauuuauaauaaauggcgaucuuaauuacucauaauauguuuauuuacaaucuaacucuugaaugcuucuaaauaaaccacaauucaaacugca

SEQ ID NO: 12490 - RNA, 62473 nt, Mus musculus
ccucccuucuucccuccccuccgcaggaaaagcagcugcgggugccaggcucgccguggcgcgcgcgcggcgugaagggcggcggacaggaugcgagcgcaguggccgggacaacucugggccgcucugcuggcgcugggggcgcuggcgggcguuguuguuggaggugagcgagucgggugcgcgaaaugccguaggacccugggaacccggagcuaggacugagaagcagaggugcggggggcggauccuucuucccguggccucgagggcgcaucgcugguggcggagauccuggccuggcccgggaagcagaggaaagauggagauccgcugggccgucccggugcgcuggcagaaggaugcagcucaccugcuugggugggugugugcgcucuggguugccccuuucucuggagugcgcaggacaaucuucuggccgccccacuccuuaaggaggagcagggauucgggcuccgucccuucuggggccgaccucucacccaacacucccugacugugugcugggagucagcacagagguccuuggggcugacuuugucucuccugcgugugucccacaacaucagcugccugcaucgucagcuuucaggcccacuaacgcugcagggaaggggagucauccaguccgcagagccuaggggagcgggagggggugguugcuggaggucagcuggagcaaguaaaacccgcaguugugugugugugugugugugcacauguguguaauacagucucauauauuucaggauaccucacacucuguguaguccagggugaccuugcacuucagauuccccugugccucuacuaaggagugcuaggacuauagacaugcaccaccccucaggguuuauaugcugcagggagucgaacccagggucuccucauggcaggcaagcacuuuauuaauugagcuacaucuccagacccagauggacuauuuguuaaagguaaacuuuauuaaguugacuuugaaguuaaguaaucuaaaaaaagauuuugguggcugccuuccugacccuuguacggugguacagaugaacauagacaugggacagggaaagggaaagggguuucaguagagaacugauauuugucuuuuguggcagaagcuuccaagcgaaagaugaaaacuguggucuuuagccuacauugaacaagcuuugucaccacagaacaggaaccaggcucucuagcauucugcccuggagauauuagagucucugucagcugcugguagccguugauggggaauggggaaauccuccaggaaagcugauguuucuaacagauaggcuaacuuucgugaauuuaaaaccuuuuaaacauuucgacuuaauuuuuuaauuggcaugucaugacaggcccugcuucuguacagcgugaaaguguccucacagauaacagauacacugaacaaaagauagcuaguacucuuuguguuaggcaauuuccaguuccccucagcuauuuugagauuuuacuuaaaacacuuugugguuuguuuguaucuauaacuuucacauugacuucugagugucaucaucaccaccucaggauagaaagagauccuguuuaaaaaaauagaagugauauuucugaagagugacacucagguugucuuuuggucucugcccagggacaauuguauaugagcaugcauguacaugugcaugcguguacacaugguauacacaccaaacaaacaaacaaacaaacaaacaacggauccuuuaggauaucuguucacagauuuguugugauuggaauaaucuagggaggcgauggcuugugccaagcuagccucaggcucccucugagaggauguagaguccuguugaggggcagaagccucuagagcauccugugcaagaggugucugucauacucacaugccaucucaguguugguggcagaguugcaaacaucacuaggucccuggggaagcaggcaguguggugacuuuggggacacacagaacagggucggagugaggugccacagaagggccuucagaguaggagggguaggagauucugcucugaggagacgcugacuuucaguuucuaacuacaaaaguaauccuuuuagcuucaucuaaauacuuuguuguauuuaaaacaaggcguccuuguaucgcaguggguauucuaaccuaauuaggucagcuaggaugaggugcuugguucucuagaguccgcauucugggaacuguccaacuaaagcucucuucaggaauccgcagggccaggagagaugaggaaaggcuuuuugcuggggaagagggacagcugggguuuaagcaagcgggauguggguuugauucuuagcuuugccccugauugaccaugccaucuuguuaaauuaccuaauaucuuaguugggcuuccucaccuguaaaguggagaaaaauagugccucucguuggcagacuaaaugagacaaaggcucaaaugaaguguuccaugcguggugauugcuguugcuauuaagcugucuacuauggacugcgggccagagcuguugcugcuucgugcauuggugcgguccaggcucccagcugagaauucagcucucacagccucugaauucagcucauuccucugugguagcuuggcauauuucagcccuuuggguccuccaagaaucuacagagaagacccaggaggagagauguccacacauucauuuuuuuuuuugagucuuaacuuugcauagagauggagggcgguaaaauccauacauaagacuucagucucuacagggagagcaaaauguauauuuugcucagcacugugcccagugcuuggcacacaggcaacaaaaaaauuuauguagggcuugguauaaaaaggcaccuagaggugaugucucuuuacuuggagaaauauaauauuuacauauuuauagucucggguguucuaccugaacagugugugugugagagagaauauauguuugugagaaugucucucugugugugaauauaugugagagugugugucugugugugugagaguguguguaugugugugaauguguaucucugugugagagugugucugugugugagagugugucucucugagugugaauuguuauguuugaguauauguguguauguaucucugugugugaguauauguaugugagugugugugaguguacguauguauguaaguguauaugagugugugucuauguuugaauauaugcaugugaguaugcaugaguguggaugaguguacaugagugugugaaugagugugugucuaugugugaguguauguauguaugugaguguguguguguguguguuuugcugagaauggaacccaggguuuugugcacaauaaaugugcuucacuacuaaacuacaaccccaaucuuuugaauccuugcacugauguccguccucugaccagaggaugacagaacacagggguccucugaagugucucccuuuucccugucuuuggagggaaucacuagaauaaucuuuucuguucuuccccucaaguucuugagcacgagggcaaaggugagacguggcauuuguggcuuggaagagcauccaaugggacaaggaggcagugcagcgaggagagggaucugaaugggacucuagaauucccgacgaaaacucuuccuuugcaguucuccacccuccuuggcuucucuguuuaucauugccuccagcugcaggaauccugcccuuguuggcagaaacagucaggaggcaugcccacaggaaccgcaagucaugaaucagcagacagauaauuaacugggcaaggagugugugugugugugugugugugugugacugagcagcuucaggaauaaaccacuugguuuguccuuagccucugugcugcccacagaguggccugcuguaucucaccaucuccuccucucccuucucuccaaguggaaagggucaugugccuacugcaaacucaggccacuaguggauaugaaccuaagaucuggagaugaugcugucuaaggcuucuuuucuuuggaaacuaccagaauuuauuagaacuugagacuauguagcauaaugauaagaacuuacccuucucucuaggcacaccauguccccagaaaacuuccacuucuuuuaaggggcuaggauuggggccuagagaucuggcuagcaguuaagagcacucgaucuugcagaggagcuggguucaggucucagaacccacauaguugauugccaauugucuguaacuucaauuucaggggaccugacacuuucuucugagccuuaggcacugcauacauaaauacauacaugcagucaaaauacuuggacauauaaaauaaaaaguauaucucuuuuaaaaggaguguugggcuagagagaugguucagugcuuaagagcauuuaauacucguucaggggacuugggaucacuuuuuagcacccgcaggagacaguuuccaaccaucugcaauuccaguccuuggauguacaugcugcacacaaacucauauagacacacacacacacacaaaugaaaauguaccaugggguuuagcauccucaguguguaauucuguguauuuugguaaagacaaauuaucaccgccauauugaaaauagagaguauuuuugguauuccaagaaguucucuccagcuucuuuguaaaucuccuauugccacgucuggucccuggcaaucacugcucugucuccugucccuguagaucuguuuguauagaauaucacagagaagagaucacggugaguagccuuuaagucuggcuucccccuuuugggaugcacuuauuguucuucugaguuguugcuugugucaguaauuccaagagcucccuggggucguuccauccuacugcagugagauaucacccuggaugcagugcagcuaccuccaccaaaccuuggagguuccacugguguucaaucggagagacacauuugagccaugagagguuccuacuacuagguaaagaauugagagccuggugcucagcacuggggaagcagagaccgguagauugcugugaguucgaggccagccugaucugcagagcauguuccaggacagccagggcuacacagagaaacuuugcuccaaaaaagaaaaacaaaaauaaacaaacgaaagaacugaggaauuuguaacaaucucuacuugucuguuuuucuuucuuucuuucuuucuuucuuucuuucuuucuuucuuucuuucuuucuuucuuccuuccuuccuuucuuucuuucuuucuuucuuucuuucuuucuuucuuucuuucuuucuuucuauuauucuugguccuaaaagcaaccgauauuuccaaauauauuucuauuagguuuuuauauauauauauuuugguagucuguauuaugaucacuguccccuccuuccuccccacaaugacucccaauuccauccccccucccaaguuuaccucuuccuucuccuucucuguuuuucuauaacucaguaucccauaugugccaucuauauacuuaauggaugugaaaccauucacuggagagggguccaccuaccagggaccacauccuugaagaaaauucuccauucuucagaagccaucagcugucaacaguggcuaaguuaggggcggggacuugugagccagcccucgccccugcugggacuuugacugucaugaucuuguguggugaaccagaggugccgugguaugaguagagcugucccaccacaccgagaugccagugcuuuacuuuagucccacccaacaucuggcucuuacgaucuuucugccuuggcaacagauguuuuguggucuaauaggacaugucgcucuugaggucaacggacuggucaguacgccuggauccguucugcuccucacguauuugguagcaucucugaaaaaacaaaauaaaauaagacaaaacaaaacaaaacaaacccacaaaugcaaacaaagcaaaacaaguccuuagacaucacacuuugccaggagaccacugccaucccugcagcuccuuucccuggaaggccagagagaaagagugaggugcagacauguucaccauuagaccaacgucugauuugucccuauuugucccauuucugacagugcuaccagucaggaaggugguguauucuacucagaccccccaccccccauauguacagcuagcacaugugugcugauacaguuuuuucuguaguuuaacuugugcuacauacaacuuccuuuucuguagaaaaauucucaggaaaagagcacuaggccugugguuaagaacuuacgucaugcauggcuuuguggguuuuuuugucaauuagcuggaggaccaagcgagucaccuuaucuguaagccuucauccugguaucucagaggcuguggagugggugaaggggcagauuagauuuuuuuuuuuauuuuugguucaggauucucucuuuuucucucaucucuuacuagagaaguuucuccuuuaacuucucagugauuuggaacuccaugcaaagguucuuugugaagggagaaguccugagguuagaaccaggcuuguaauacugcacuagaagagcguuccgggaggcugucaaaaggcacacccaguagccacuuuauaagucccuguagucaacccucuuugcugaugaaauucuuagaggcaaaaaaucuggugugugagcucucccaucguuacaaacucugguguuaacucuccuagacuaauccuuuucuccaaguguuuugugaggacuguauuugagcaucucaccagaggcuggggagugcugagucucacaacuugggaacagagcacacuugagaacagagcacacuuugcccugagugauuccagaaggccauagggauaggcuggucaaaguuuuuguuuuuuuguuuuuuucauucucucccauuauuaucauuaauccacaaauaaaaauucuguaucugauaugcagcauaauuugaaauguaaacauugggaaauggcuaaaucaugcuauaggacacaugaauuagugcacacagauaccacuuguuucuggugagaaacuuaagcugcuuauuuacuuauuuuauuuuauuuuguuuuacuuuuuugagauacggucucuguauguagcccuggcuguccuggaacucauucuguagaccaagcugaccuugaauucugaccuuuauagaacagaaggaaaaccaagagaucuauguauauauagcauggugacuagaguuuucaacagugugucuucuacuugaaaauugcuguuuuuaaaaacagcugggcuuaguaacccacaucuuaagucccagcacuugggaggcugauuuuauuauuuuauuuuauuuuuugagacacggccucauuuaaccuauguuggucuugaacucacuuuuuaaugaggcugucuuugaacuccugaaucccccugccucuaccuccaaggugcugguauucugugugcuacuauuucugucucugauuuuaauaaauguugccaaacaaccuuccaucaaaacugauuugccuucuuaccaagauugguugguggaauuguucacaccacaaccgcuggcaccauaccauggaaaguuggggagggaugccccagaacuacaaagcuggaugccaaggucaccuccaggacaccauggagcugugcaugaaacagagcauggcacaggcacgucucuucuguacacugaaugagucaguugggggcaggguggggcugcugugaauaaaaucucccagaauucuaaaaugcagcauuugacccagauuuuaggccaugaggaagaaauguccacuuguauacugagcgacuucaggucuaagaauaucuaucuaucuaucuaucuaucuaucuaucuaucuaucuaucuaucuaucuaucuaucuaucgcuucuagaguauuagcggucuuguugacaccuucugguucugaaagaauauacguuuugagagccaauagcacucugaagaaccucuaaucaaguacagaaaagcugaaaggggguuccuaagaagugagggacucacccaaaucacaaacuaguuuagugacuggugaggucugguccugggggcuccugucuccugccagggugacuuccuucugaugucccauuguagacaaagggccugcuuauuaugaacuugagguagaggagaagagagguguauuuguggugcaggaagcaacuggauggaggaaaauggggaagaaaaugggucauugauuggacaguuaccacaugccucuuucacauauguuaccuuaccuaauccucgugcaguaaauauuaugcccuuauuugggaggcugaguugguggggaggggauaaaaauagcugucugggcuuuucagagcuugucugauaaagcuggguggcccauagaguacuguggggcagugauaaaucuugaguaggcaagugaccggguuuuaaagagagcaccagagaguugggugccacugagcucauacggucugcagaauggcaaggacuucagaccucuuggacgaacugcuuucucuugcacacccgcucugucccuccagggcuaaguguuagcuuuagaucacaguguucacaggaugggauuuuacaguccgcaucccauggcuuccuaagugaccccuuuagagacgauagccagacacggucuggcuucacuuauaaagguagggaggguccuaguggcuggaggggcccugaagcaggaagcccaauagccaaaacauaggaaccuuuucuaaaguggcugugcucacucaaaucuucccuuaguuccucaugccuaauccaucagcaaguccuuggaauagagugcaucuagagucugaccacaccauugacaccgcugcccuuucaauccaaaccguugcccggauuguuuuuaauuauaucccaaccgauccauuuuccuucuggcuucgauccugugcuugguggccaggcugagcaucuccccuucgcuucugcucagauuccuucagcaucccuacugugugaugcaggcugugcucccaauugugugcuggccccuaguucuccagucucuccucugcuucucuccuccucuuuccucugucuuccugcuauuucuucaaugggaggaggucuguccaucggacuuuguucuuuggcgaaugccuucccguuaaugucacagcaucauuauagaaugucaaccucccagaagaaccuuucuggacuguuuucuguagcugacacugcuagacuaguuuaugcaugacugcuuugccuugcuuggaagcauuugccucugcucucucucucucucucucucucucucucucucucucucucucucucucucucucucucucucucucuccuguuucuguuuuauuauugccuuccugaccaaaacaugagcaucaccggaacagggacuuguucaguucauccauguuucuccagugccugggagugcaaggcaggugcucacugaaugcuuguugagugaauaaaugaaugaaugaaugagugaaugaaugcuaggaccguugauaaauauuggcagaaaguuguauaccuaaaggaccuucucugaccuuacucaugggugaaucaaacauggcaaaguuuccaugccaagauggcuaauuguuuuuguuccaauucauggaaguaucuaaggacacacugcucaucaaaacaaugccacauauggcuguggaaaggcaaauccgcuuagaauucauuucuuuggguugucgugaccaaguccuuaaguugauggcuuaggacaucagaaacaugugucugagauucuggguagaagccaucuuugccucugcuuagcuucuaguggcccuggcacuccuugauacuccuugcuucuagcuuuuucacuccagccucugucucugaugccgcuuggcgucugccaucugcaucugucuuugugugggguuuuccuuucuuacaaagguauuggucaucuuggguuagugugcacacuaaugaccucaucuuguuuacaucucugugaccaaauaaggucacauucaaagguauuggggguuaagacagcagucagucucucucucucucucucucucucucucucucucguguauauucaaccaauaacauuuuaauauuuacucuugauggaggcaaaucacacacaauuuguauuguuaaauuucacauuuaauuggcuuggauguacuuaaagaacaauuuaaaaucugaaaccagauaccucugcucucuacugauccagcaaugacccuuggagccuuuugcuccugagggcagaagucuguucucaugagccucacacccccuuccucucccucucccuccuccuuucccucucccuuccucucccucucccucucucucucccuccccuuccccccucucucuuuccagcuuuugugcuugcacgauuccuucagcuacugagcuaccuacccuuaagagagaaauaaaaaccaaaaauguuccuugcaacuuguucuugauaacccauguauguaugcauagggccguuaccaugagcuauucuguccauugagugacccacucaggagacugcauuggaaaaucaggcaccaccugggucacccacugaccccauggaccuaagugggaagugacucaagcucaagggcagggcugaggcuccaggccagcuuuuucucuggcuggcagcgagagaucugcacaggggucauuaguguggauuguccuccauucucaccccaacuaaguccugaugcaagggcguacugccccuacauucugacauccugugucccuggacaacguguccuagacacagcccucacugaugcguuacgacuuccccuggucccaacuuguuuccuuuuugccucuguuuuuuuuuuuuccccacccuuuaucucauuucugguccugugaaccaggcugaaaggccaaaccacagccuuguaucuccacuuuccaggcaaacuucuuggcugguccugucugucuuucccagugacugucuucucucggccccuguuccuagauuggauuuugaaugcacacuccuuguucuguuuagauuuucaccucaucuugauacguuugggccccacccuugcaucucuaaccuacucuucagggcuuaauuagcuuugggccuguguccuguauacagugacuuuaaggaauugaaaaaaaaauuagcaaaacauuugucugcuguaaauagcucgaagcuaaggauaaaaaaggcaacaacaaaaccaacuccggccccagcguucauugagcacuuucuguccgccagcugucgcggucacgaaugcucauugaagcuuuacaaccaggacaguccuggucaaccuugcuuggcuucucucacacagguuuuggggagccauccauuguuuucacugacguucuggugaggaacccccacuucuccaguaagcccuucuggacugcagaggccuagaaggaauccaggcuuuaugaaugacuagaaauggagggugggaggggacccauaagcccagaagggaggggcagcugggcguagcaggcuuugaaucagcuugggcccaccucagagaccucugaugagucagucacuuucaaccaccaugcuccagggcuucuguccuuaguggcaggacucgguuggagagguuguugggggauuauuuguucuuccacugucaaccugggauucauuaacacaggacaucaagggaagaggguaagggacuuucuaaaggagcagcucagcccauucuuugaggucacuggcugcugguacccugggaggggccugcugucucuuauuucacauuuggcaaggcuuucuguuguggcuguaagucagaggcucauugggaaugcuaauuugagagugggugaauggaugaauggacaaacggauagacagggggaggguuuugaacaauaacgugggcugggcuguagaaauggcucaggaaggcaaaggugcuugccgccaagcccgacaggcugaguuugauccuuaagaccgccacgguagaaagagggaaccaacucucaggguguccucugucucacauguacuauggcacaugugcccguccauucuuucucauucucccucaaacaaaaccaauaaauguagaaaaaaagaacuugauuggacccaucccgcuuuuuauuguaacuaccucccuuuggauuuccucucuuucuagugagcauuggugguguuuauguccaggauugcucuuugcugccggucuccauggaaacuccccaaagaggggagucacugaaauaguccagguuggguucuucucagaacucuucugauccagcuguagugaagagggcucuguccaaccccaggggaacagcugugaggcuaaggucuggccagacugcccuugcagggaggauccuugggugacacagcugguuuugugggcucagaaccuggcagcuguggaaauaucagcuaccuuuccuccaguagaccuugcauuguugagaguuaacccacucaggugugcuggggacaggcuuggagccaauugccaucuugcuauuuacacacucagacucucucuuucucucucucucucucacacauucacacacacacacacacacucagacucacacucagacucacacacacucugucucucacacacacguucucacacucaugcacgcuuucauacacacuuucucucugucucucucuguugcucucucucucacacacaucacacauauccucucucucucucucaugcaaacacauacacauacauacaauacacauucucucucucucucucucucucucucacacacacacacacacaggagaauagagccaauaguuauucacgagcuugugguggugucucacuggucacauguagaauggaaaaaaagccuuugaagcaagacagcaagucagagcccagccucugagggacccuggagcuucuaaacggcgcuucaaggauuccacggccaauccaguguuuugaggagaugaaugauaucauauauuauccaaggcuccauuuacauauuauauguguaugguuaugucucuguagaucuaaaucuaaaucuagauauugaaauagaauccugcugcuugcaguguggucuaggauagcuccgauucaugacaguaaucuugcuguagcuaccugauugcuggaguuauaggugugcagcaccgagccugguucuauagguuuuauucuagaacucuguauacuguuuagaaaugagcuuguuugcagcaaaauaaaacaauuuagccccagaccuuccaguuggcgucagugcaucuuugggcugguuuaggcaggcagaucugaaggguccaccugaccuugccuugucuuccccugcucuccccaucuccucuuuucuuccuuuccuuauuuuauuuccaugcuggggaugaaacucagguccgcaagcaugcuaaacauucguuguacuacuaagcuauuuuaucagcucuuaaaauguaauuuuuaaaagaguaaaaguuacuauguucauauaaacauacagaaagaacauguaucaaagauucuaaucagcuuaaacagugugggaacugguaagguguuagaacuaguucaaagaggaauucaaagaagggcguuuuauaguuugacagucauauggaaauagauuggcuaauagauugacacaauaagcuuuaaccuuuggggcuuacauucucuaguagguggauauuguugacauuuuuguuggaugagaaucguauguguuuuucucauaaaaauagauuuacaacaucauuaucaucaucaucaauuuucuauguuaaucucuacuuguacaaaguuguuaagcauccuaaucaggucaagacacugaugcagacagauagucucugaccacggcggggcauuuucugagugugucccgcucagcuguugagauagcuagaauuuaguuauaauaaaauagauguuugacuagagggagaugagacguucuggagaugucaagaaaacacccuggcaauuaggauaauuuauuuggaaauagauuggcugguggcaaagccaaaaauaagaguuaugggcaaaggaagcccuucagaaagucgucugaggacugucaggcugugugaggaggaauggcucuaccugcuccugggugauaaagacuucccggaggcacaguaggcagagaggauuuaucugucugaggccggggacaccacgggggggggggggggacaccacuccaggagagaggcuuccacgaggcagcugccugagauucacuuccuggcugcuucucagcacuauuuugguccgcuuggcuguccuuguuccuccucccugcagucuucccccugccgcuugucaauguggggagucuucacuuuugaguggcauccugaagcauccucuuggcuuauugaauucuugcaaaaauccugagcgauaggucagccauuucauagagaggaggggagcugcucaagggugcaguauggagccuagaccuugcaucagagcgccucagaagugccacauucuuccagcccccauuagccuuccugaucucuaguucaguguccucagccuuccuaaugcugugacccuuuaauacaguuccuccugcuguggugaccuccccccaaccacaaaauuauuuuguugcuacuucauaacugacuuuacuacugugaugagucaucacaguaacaauuguacgacuguuauguaaauguuaugcuauguuuauuguaacaguaaauaucugguauguaggauaucugaugugugggcccccaaggggucaugaccccacagguugagagccaucacgcuaguucuuuugugugcauucaaugcuuaggcccucaagauagauguauuggaaagcuugacacgaguucagauagugggacauggcaauugagguuacccugcuuucauuaaagcccacaguauuuaggugucaaucuuacugcaucugagucccaggaccucuguaguagccguggcugcaguuagacaguuggagauggugcauggccuuuacgcugggccuuagcuuuucauucgcgcagugcagguauaaaaccagccacugauuaaagccuuucugucauuuacuauggggcccuugggucuucauuugcugauaaaggagugaguuucucccuacccacuuucuuuuuuguguaauagcccauguuugguaacuugcccaauggguaggguuagaguauguuuguguguaucacuugaguguuugggaaauuugggguagccggggcaggauggucacugcucugagcaaaucaggugcugauguccuugccucuuuguugcagaguccaacaucuguaccacacgaggcgugaacuccugccagcagugucuggcugugaguccugugugugccuggugcucagaugagguaaggagccuaugccuuauuugucaaugcaauaacacaacucugaccuuuaaaaggaauaugagguaguuuauccuggagccaaauguaaguggcuauggccaaggaacauagauucaaauacuggguuccaacgugauaagcacuauagugaacguuuuauaguaacagaacaaagaaggcaauaggucaagguacuuuagacacacauuggugaaccaucagaugaggugguuacagcagucaggagcgucugagguuaccucauaacaguccuagccugugggguugguggaagcuaggagucugcacauuuuagaaaggacuuuacuagucuuaagaauguuaagucaaaccuagaggugggcaauagguagcuauuuagggggauaauuuagccccaaacuauuuggugcccaaccuguagcauucaucugaucuuguugaauguucaacacagguguggcuccccacccccauccuaacuugccccagaugccuucuuucccuagauuuaggcgcuucaguguaggugcaggcacacagaaucauuuccuuccuccuaaacgcagucucuuuccccuucugagcaagacuaggugacgccuuccucaggaugcaugguggaagcuggcaaugauccuggagccuguucugcccuuccacuccagccauuuugcuugggcaucgucauuacugugauuauugcuacccuuccccagccuauacuugcuuugggcuggaacaucucauggaagaaaggcuuuacucucuaaagaagagaggcgcuagggguauagagggaugccagcucauccgacccccccccacccccagagcaaaacaaaaacaaaaaacccuaaaaacucagaagaggaauguuauguguguguuuguaugugucucugugugucuauauuucuguguauguuuauauguuuguguguauguguguguuugugaauguguguguuuguguguauguuugugucuuuauauguauguuugugugucuuuguguguguauguguguuuguguguguuugugugcauguauguguguguuuguauauauuuguauauguguguuuguguacacuuucuuaaagauccuuuuuucuucccuucucucugacagugacgccccucuaucuuccuuccuuccuucaucucuaaaguaucaauggaugagggagcacagcucaauggugaggaccagacgaugacaggaagggguuagcugugucuaggcagaggguguguugugucugagucccuagggaaugagugugucugagggaauggcuauguuuguggccgggcugggaauuuggagcuggcaagagcugauggggagguaggggaagccuguggcuggagagguucccagcaguuccagugggagugagucagcacccccagcaggugguuaccugagcugcuggccugucugcuccucagccacuagagcuacagccucugcccuauaccgcuccucaaccacccuagcuauuuccugaucuuugucugccucucuucuggauccucuggguuuccuaaaaaggcaagcuccuggucagacuggggaggaagggagcagaaggcuguguuuacccccuagaggaggggcugccagagccuccaaggccagcuccauacacagccuuggccucugcugcucagcacgggaacuguuucuaggggcagcugccuaacaucugggccagauugaucucauuuagcgaaugaaacauucucuggggcuugggggagggugagcccauuccuucuccacccccacaggugccccuccccucugggcuucacuggaggcucaaguguggcguggcugucuuccuucugguuugucauauccuccugccuccggucaccaucaugguugugucaagcuuccuuucugaggaaguuguaauucugcaacaauuccagaagaaggagugggaugccgagggugccguguuuggauaggauggcuugaaguuggacggccggagcagaggggagcagaaaggaggucccugaggaaggacuacugcuauucaagcauaguccccucucauucccgcaucuggaucuuauagggauaaaucagagcuggguucugaccagccaaagccccuccuuaggccacgugaacauauuccaugugacuagaugcaaauguggaauauuuaccaaucacuauggugaaucuuugcccucuggggcagacugggaggccagagggagggaaagaucagcuuguugaugggguggaguugggaaauggguagcaaccaggaccaaaggagaccaaagaagggagguaggaagcccgaugaaauagucccuucagaauggaauaaagugaaugccaauauuuaccaucgcuaagugagagggaggagggguggggcuggggagucugauguggggcagagugugucaagcagggaggaacccugggcuguaacuaguuaucuuuuuccugagggagcuggacuucucuugcacagggcaagcugaacuauugaaaguguuuggaucuugacuuuaaacauccaacgguggggcugggaucccugcucaucccucugccuccccugucuugacuguuucaaguggugcugauguuggcagugccucggaaaacaacugguugggcucggcuugugguccuuaaaggacagcagcuccuggguguguauagcaagcccuuggcuggguaagaggaaaacagagccaaguggaugaguggggugucuugggcccacccaccuaggguguguucuuggagagacagaggcauggguuagauaacauggacuggaguaauucgaucucucugaucagcacagcuagcagaggcaucagcuucucacagagcuagaaccuauauuuuuggcucaagugguaacauacuggauccuagaacuuucugaaaucauaagguaauuuaacaagcugggagugcuugucaaauauaaaggcucuggggauggacccugggccuauugcaacagaacagguugucaugguagcaagagggacaacauugcuacugguggaggcugggauuggacaggauggguagagguagaauugggcuugccagauaaauacagaacacccaauuccaguuggauuagauaguagauaauuuucaucuugguaggcauugcauauuuccuaaaguuggcaaucuuaagacaagaagaaaugcuaggaauugauacccaggauaccugagccagguuggaaggugggccagcucacaaacuugacaucuaagaaugaaagaggaagaagaacagguuuggguuagcaaguagaaggccccagcuggauuugcuuucugcucuguaucugcuggggauaggcucaggacacuauaauuacucugaguguguguguguguguguguguguguguguguguguguuuaucagggucucaugagcaugucugaagucucuuuauacuuauuuuuaaccuggagcauagaugucccccuugaguuuggccccaaacuuguuauuguuuaaaaaaaaaaaagaauaaaaauguauaguagggucuggcaaugcaacccaguuggagagccuguguuacaugcgugaaacccugagcucaacccagcaucgcauaaacugggcaugguggcaacaugccugcaguccugguccucaggagguagagguaagaggaucaaggucgagguagaaguucaaggcuggacuagggagauggcucaguggguaagcacuugccaugcacgcaagaggacuugaguucaaauucccagcauccugguaaaagcugggcuuggcccccguguuucugacugcaguguuggggagcagagacgaagagauccuaggagcuugcuggccagauguccuguccaaaauagucaacuucagauucacagagagaccuucuaucaaaaaauaaggugacuggggcacagcucuaaucccagcagcagugagacaaaaacaggcagaucuccgugaguuugaggucagccuggucugcguagggagcuagggcagccaggacuagaugcugagacccugccuuuaaaaaaaugaaagaaaaggaauaugucccucaucuucacaaccaacaaagcaugaaucuuaguaguuugaggcuagggagacagcucugucauagagccuagcgcauguaaauccacucccagggcuuccuccaaggagaagagcauacaguagcaguggccguuauaauggggacuggaggaaagcggcugguuuuacuuuuauuuacacuggacccccagaggguuugaguguguuugacucauacugagacuuuguguuuugaaaucaucucacagucuuauuuuagccccggcccaacccugugagacagauaucacagugaccauuauucaugcuguacuuuccuuaaagaggauuaagcgggggcugcuccuaauugcguguuucacugucccaggaaagggagguaauccaggagcggagccuggagccucccaccuccaugggugaucgcuucccccagggggcgggacuugacucauuccucuaacauccggguuuugaugggaacuagaacauucacaucaaccccuuuucuaguuuucucucucagugaccuggagauaucuguucucccaucugggcuuggggugggacuguggccaaggguguugaagauguugccuugguaucuuugggaucuuuccagagcuccaggcucucaggaagagcugggccauugagcaagccuguuagguuuuugacuuguaacgucaucgauuguaaagggagggagacagccuggucuuauuuuucaguguuuuuuuucccccccuaaggaaauuuauaggaaggguaaggacugucggcacgucugagcauucaacucucucuucuuaagacugagguuagaaaguggagugggggggggggggcggcggcuggagagauggcucagugguugggagcacugacugcucuuccagagguccugaguucaaaucccagcaaccgcaugguggcucacaaccauccuuaaugagaucugacgcccucuucugcagugcuugaagacagcuaguguacuuacauauaauaaauaaauaaauacauuaaaaaaaaggaaguggagcgaggagggccucucagaagcaguugcuccccuugcugagccugaagaucuggguggcuugcuauucuccucagaucccuggucuccccguccugguucccuccaucagccucugccuugcucuggaaagacucaggucugcuggccuccuggugacuuaaucacagccuuuuugggaggugugugggcaguuggggccagagauaagagucauggugacgaugguggugaagaugauguguguguguacaugugugaaugcauguauguauacuuuuguguauauguacaugcgugugcuuuagaaggaagagauggcuuccugagacuguaugguuuagaaggaugagagacaggcacagacagagauggguggcugaucacaaggcuuggucuguccagccguuaguucuucccagcgcuuuucuguuaggugucaggauagagguuuucucucaucgucaggcauggccuguggugucuuuuaugggacauuugucaccaagaagguuaagucuuauuccccuugugggggcuacuccucugccucauaucugaaagcugagagagaagaaagguacaggccagagccccuuucucuuucuguuugggucagguugagguguaugcguuugcguguguguguguguguguauguguguguguuugugugugugucuguaaggguggaguguguaugugguguguguguguaaaaugaugcaguguguauguauguguaugaggggugagugugcaugugugauagagugugguucguguguauguguguaugugcaugugugugaggguguaguaugugugugggggugaggaugagguguguguauguguguguauaguguguauaauguguguauguguguguguagugaguguguguguguguaguauguaugggugagaaugaggugugaguguguauguguauguguaguguguagugaguguguauguguguguagugaguauguauguguguguaguguguagugaguguguauguguguagugagaguguauguguguggagaguguauguauguguguaguguguaugggugaggaugaggugugagugcugcacuguaucacuacacacacaggccuuugugacugaucucucugcagguguccugguggccagguuaugcacaacugaacaggaaggacuuacccaucuuucccgaucuucucacagccuuaucuugcaucccagucucugaaugccuggggcauucucugcuguggcuccuccgggcacccuuccucccauucuuaacuagaaaguugaguuccucauuugugaagacccucccuagagguucuucaccugugaaaugauaaguaguaauuccagcauuaccaagcugugagcauugcagugacuuuccugaagugcuugucccaugcuguaugcagugagggcucaguaaauguuaauaguuguucuugaauauaugcauauacauauugaugauggcuuuugaauggugguaguuaggagagucugaagaccuagaaacaggggcagguaggggugugccagcuuucaggucagucccccaaccuggcaugugacggcuggacaugagcucacgcagugcugguuaaauaugccuagugucaggguacgauggaacugaaaacauccuguuguuaaccccacuuaucaaacaaaucaggaaacuaaggcucagagugacuucuguggugucacguggcuagcuagugaugaccuagaucugaggccuguuuccugauuucaguguccuuccaagaacauuucauucuugcaugugacacacagacccagacccugaggcugaggugauacauacgugucagugugguuuuuuuuuuuuuguccagugugaaggaggaagcugagagagcugccagcaccuguccucuggcacuuuuccucagcuuguggaguuuauuccuagguagauuauucaggaacuacucaacggagcaugcugacagcugacuccugcugagugccuucugcuugccugguguuauuuagccuggcauggcauuccuacgaugagagguucuucuuauuaaauagcuaauuccuucuaaaguauuuuuuuuuuuauugugguagaauacauauaacagaacuuaccaucuugaccuuucugugugcgugugguuguguguauguguggagaucuauuuugugugucuuccuuucucucuaccuuauuucuugagacucagggucucucacugaaccuggagcucaucaagauggcuaacgucgcuggucagcaagucccagggcuccuccugccucugccucccuagcucuggguuugcaggcaugugucaccauacccaggucucucuuugugugugagugugugugugugugagugugugugugugugugugugagugugaguguguguguguguguguguguguguguguguguguguguguguguuuaacacgggugcuggggauugagcucagguuucauucuugugcugcaaacacuuuccugacuggacaucuccccagccccuuccuacccauuccuuuccaccguaaccaccuuaaguguccaggugaguggcguugucuauguauaaugugaagcccucacugucaucuguccccauaacugaauuucauuaugcaaaauuagagcuuugggcucauuaaacaacucuuccuccuccuccuccuuuuccucagccccuggcagccacaaucucccuuugcgucucuaugguuuugauugcugucuguagccaagggugacuuuuccccuucaugauacagcugaaggaagugagcugugugucaugcucugguacccagucaguggugacaaugccuggagggggugggggugucagucucagccagucucagccagcucauucuugggcucuuauucuuuacccuccaccauaucugcucugucaucuuugucuuggauaaagaagggaggcaggaaacacacaaucauggaccuuauaaaacaggcagcauguaacacagcauugauaaaugguuuuaaccuugacccacagaaagaaauaccucauggacuauuacucauuauaggugccaucuuccaguaaauaaaagauuccccaaauaaugaaacuuuuauuuauauacuuggauauuuucuauucuauuuaauuauguuuuacuuaguaaacuugauuuugagacucacaaaguaaucauauuuuacaauuuggaaaauacuuguuuagcaggcuucuuacuuaauggucccucuucucuguugucaauccaugaacagacacuaagucagucuauucucccuuccugugcgugccccugaggauuaaccauggaaggaccaugacaauucuuuuaugcuagauuagcuccaaagagccagagaagcucuuggccagggggaggugacuuaccaggcaggaggcacagccgcccuagcucugauguugaccuuucccucgggcucuucucuucauagacuuugucucagggcucaccccgauguaaccugaaggagaaccugcugaaggacaauugugcuccagagucuauugaguucccagucagugaggcccagauccuggaggcuaggccacucagcagcaagggcucuggaagcagcgcccagaucacucaagucagcccucagaggauugcccuucgacuacggccaggugagcgugggugucggugugggugugggaucaucuuggggagagaccugaaaccagugggcacaggacaucaacuguugaaggucugagcgggaacuccucccgggaggggcagcacaggauaggacugggguggaaagagaaggggauggggagugggggugugugggcaggagaauggaagacaaugaaaggggucaggauugcagucagaaaaucugaguaugaacccccacccuacaacacugcuccuuguggcucugcuucccccugaugugugcuaucuaguugauagcucugauggaggaccagauaagcagaaggaugagaaaggaaguuguaagccucuuucccucagggcacaggaacugugugggagcaggcaaaguagggacagaaaagggaaugcuauuaggcuaaggggagcuuuuuggaguaucuagacuugacuugacugaaucaauaagagcuugagagagauccacucuaugcaaagaguccuuugggauguggagagaacacggugcuauuuacuuuagagacauuaccucuggucagucaggaacucauauguagccuaggcuagccuugacuuugcaguagucucucugcuucugacucgugcaugcugggaugacaggcacgcaccacuauauccagcauagugccugugcuuuacagcgucugaacugaagcaacugacaguuguaugacuuagaguauagacccuggggacccagagggucccacacauggggauuuagagauggugggaaaucauagaguggaaaagaagagguucaagaugcugcaagagggcaggagguguggaguguguguguguguguguguguguguguguguguguguguguguguguguaugugguggggagaggggaggccaccaacacuuucaagcauaauuugaucaagcaguuauuaacccuccauggaggccugcucguguauuugauccuagaagaagaggaggcaggaaaaaaacccuaacacccuucugccuuccagaugauucgaagaucuucucacuucaagugcggcagguggaggauuaccccguggacaucuacuacuugauggaccugucuuucuccaugaaggaugaucuguccagcauccagacccuggguaccaaguuggccucucagaugcgcaagcuuacuagcaaccuucggauuggcuuuggggccuucguggacaagccuguaucgccguacauguacaucuccccaccacaggcaaucaaaaaccccuguuacaaguaaggacuuucuccacaagccagugaaacaccucccccuugaucaaaggcugguccaaguccuggcucccaguuuuagcuccaggauuuuccuuuacaaguuuauguuuuuaauuucuauuucuaugcguguguuugggccuguucgcaugcaugugugccaggugaccguggaggccagaagagggugucagaucccuugggacagggguugcagguggaugugagaugggaaccaaauucuguuguucuucugggaagagcaucaagugcuuuuaccauugagccaccucucuagcaucuuucaggucauuuuguugacugcuuuaugcaagagccauagcauuugcaacuuguucccugccugggagaugggccuacuaucuggaguauugugucaauagggcucauagcugccaggggucuucuacagaagugccaccagcuuuucggcuuugucacaaaugagcagaugugagggggaggggcaagcucaaaagcagagagaagucuagaagaauaagaauguaauugugauuccagaggaauuaguucuguggucccuauuauagucaccaagggcacaaauuauacaaaguuagagugcaagaaaauuaaaucacuuuauugaacucuuuaacaguauauaaauggcuacauucucuuuauccaccuccuuuauagaaauacauuuuuuagaaaauuuauuguuuuauguguaucaguguugccugcaugcuugcuuguguaccaugugugugccuggugcugccagaggccagaagaagguauugaaugcccuggaacuggaguuauagauggcugugagccaccaggugguugcugaaauuuaaccuggguccuagguccccuggaagaucacccauccauccaucucucuagccccucaccucuuuuuuuuuuuuuuuuuuuuuuuugagacagacagagaauuuugcucuguagccuaggcuggccucacccucccacgugcuguuuacagacagaagccaacccacugggccaucucuccagcccuaguaaugauaguuuuagaucacuacucuacauagauuuacacucuucaacaaguaagccauucaauaguaaacugcaauggguugaaugugaagugggccccacaggcucacacgucugaacacuugguccccaggagguucuggggucaaaggagcucuaggaauuguacauagggucuuauguuugcugggcgagugcucuaccucugaacugcgccuccagcccugggccucuguuggcuuauguuuaguuacuuucccugcugcuaugaucaaacacuugguagaagcaacuuaagagaggaaagguauauauuggcucacgucuccgagucuguauucuaucaugacagguaaggcauggaguguguaaaguggcuuggucugugguggcaggaaccuguggcagcugcuugcuacacaccaccagggcugaacagagagcugaccuggaacaauccauccuugcacauauaacccuauguaugccagcgaggaucugugcuaaagguuuuauagccucccucaaacugugccgccccuggggaccaaguguccagacgcgugagccuguggcauccaucucacauucaaaccauagcaguuuacuagugaaugguuuacuugacaaagacuguaaaucuauguacaguagugauuuaaaacuaugauuacuacugcuggagagauggcacagugguuaaggaugccucccauucuuccagaggauccaacagaguccaguuccaguacccaggucagacgguucuuuguuguuguuguuguuuguuuguuuguuuguuuguuuuugagacaggguuucuccguguagcccuggcugauccuggaacucacucuguagaccaggcuggccucgaacucagaaauccaccugccucugccuaccaagugcugggauuaaaggcgugcaucaccacugcccagcuggucagacaguucuugagccaagccucuagcuccaacucuaggggaucuaaugcugccuucuggccuccgugggcaccugcauacacccacucucucugucucugcucucuuuuuucucuccccuccacaauuaaaaauaaaguauauuaaaaugaugauuucuaggcugacaaagcauaacuuuacuucuuaacuuuauaaaaaaauucugugggacaguucuaaacuucugccugggcuccauguucccccagaaaagacaucaguuagucggggagagcagagcaugaucuguaaauuuacuggcuaucugcuugauuguugcaguaaaacaguguuaaugauaacagccaugauagcuugagcccaacucuuguagaaccgcuuuauuuggucccacgacagcucucaggggagaagcacuaugauggcucacuauagauccugccacugggcuacaccuccagcucugacuucgauuagcuuauguauuaauugcauaucuuguugcugugaccaaacccuugauggaauacagguucagagagucuaacggagagcccaugcuugguaaauggggauccagaguuuaaucuuccugucuggcuuaauggcuuccuuucuugcccuuuuggcuaucuggggguaugguuaugaugccacagguagcuugaagggcuuuggagucuagauugucucaguaguugugauuccgugaggcaucugagugagcugugugguagagcguuuaucugguaugcaugagacuuuggguucaauccuuagcaccaacaugcacuuguguaugcacacacacagagacagacacagagauucacagacacacucacacagacacacacacacagacacacacagaggcacagagacacacagauacagguacacacacagagacacacagagacucagagacacacagacacacauacagagacacagacacacagagagagacacacacacacacacacacacacacagacacagagauucauagacacagagagacacacagacacagacacagacagacacacacagagacacacagacacagguacacacagagauacacagacacacagagacucagagacacacagauacacacagacacacauucagagacacagagacacacacacccacagacacagagaaagacacacacacacacacacagagacagagacagagacacagaaacagagacacacacagagacacacagaaacacacacacacacacagaaugagagaaugagaacuaauaugauacggccuggccuagguaugccacuggccauaucugucccucucucuuuuccugacccccguauugcccuuccaucauggcuucugcuaagaugaccucucgucucccuccaguaugaagaaugccugcuugcccauguuuggcuacaaacacgugcugacgcuaaccgaccaggugucccgcuucaaugaagaagugaagaaacagagcgugucccguaaucgagaugccccagagggcggcuuugacgccaucaugcaggcuacaguaugugaugugaguucgaaaggcaagggcugccagguggagcuggcacaaaugaaaauggggaaggaaacaguucacuuggggguuuccaguaugaugggggaugggaaccacacgggacuuugcacaguauguguaguaagucugucuuuauauccaugccgaggccacagcaaacaccgcuuuaaaccacaguagcuccagaucucucugagggagaacaucuucccacaguuucuggaacuauuucagagucaagccugggucaacuugaccucaacaaagugggcagauguuagggugggauuucuucugguugaggccagcucuguggaugcagaugggucccggucacuggaggaguuauguguggaguugaaggaggccugcuuuagcaucaugaacuaaucaaugaugugauggcucccuuaugggccagauugggaagcucuaguuuaugcuccaaggcuuggggcugaggucggucuccaggacaacuuguccagcuuuucaagcuaugccgguucuggggucuuaguuuuguauugacgacauagcugaaguugugguguuuuuuauuuauuuauuuauuuuauuuauuuacuuauuuuaaacaggaaaaaauuggcuggaggaaugacgcaucccauuugcuaguguuuaccacggaugccaagacccauauugcccuggauggaaggcuggcaggcauuguccugcccaaugaugggcacugucacauuggcaccgacaaccacuacucugccuccacuaccauggugagaugccuggccccuaccgugguccguguucacucugguagggcaagagcuuuugugugaaacuggaaacagcuuuuccugugggcaucauauggggcuuagccgaugcuugucucugcacaucccacagggacucacucauccagggucuauagacacugaccaugccuguggucagugugcacacugagucuaccgucauuagcaccagccucuuggcauccagaauggacccacgccaugugccaggcacagcuggaaagcucauguuuucccuuccucugugaauggccccuucguggaaucaugcucucacuuguaguuagggaggaaaaaaaggggaggggaaaggacaaagguuucauugaugaaauaaaaaaaaccccagagagcagagucuguugaggaaagguuaaagggcacagagucaucugguuugaaggaaagaugguccauggauaauuuaggaagauauauaagaaaacuucugaaaaguuauuuuauguguuuuaguuaaccauaguuaauuaaauaagaagaaaggagcuuaacuugaaauagaagaaauugcugugagccaugagacaauguuuaauauauaguagcacuuuggguauugggaaggaagucuugauguuuuuuuuuuccugucuugucccccccgccccccccagcuaugcauucugggcuggcuggaaggcccuuugccucguagaugugaggguacagcaaugugccgcuaugucugccuuguuuguuuuuguuguuguugguuuuuuuuguuuguuuguuuuuuugagaaagggucucucucauucuauaugcagcccaggcuggccuuuaccuugcaauccuucugccucugccuucugaguguugcgauuaggagucugagcuaccaugccuguuauuuuuuuuucuggucuggaggcugaacccaguaucuuacaguauguuagauauuaccuaacuaccaagccacuccagccuacucuguuuuuuaaagucaauaaauagaggaaccaccuguaaaugaucaaaggcaggacacuugacuggagaucucaugagcucccucacaaggucuagguuuccacggacauagucaugacucguacuguuuccuggucucuccacuuccuugguauuaaccacauccaagcugagcaaugucagacaauggguaagucagcaaacuuugacacuagucuacccagagcacugagcuggagcugugagagaugaaacagcuauaaggaccuaccuacucuuaggagguuuagaugaagagagaggauuuaucccuacacaguauuaauagcauggaacucaugauguacacuaauugggugggugacacagucaagggcuauuggcaguugaaggaggaaagcucuuagaagcugggguggucaaggagggcuuccuggaggaggugagcuuaggcuaaggaaggaggaggauuaccaagaugacagguaacaggagaaaugagccaggucagugcugaggagaagaggcaggcguaggggugagugacauuuggacagugaggcugagaucauguggcaggugaccaguagagcgagguuagggcauuugcccguaauuccacaacaguggggcccagcccauggagauguuuugagccugagcgggaaggaaggugcuugguuuuggagccaccagcccaggguucauagccgagcuucugggacuuuuuacccuuucacucaggcacugcgccauuuucuguugcuaaugauacaauagcacagacacaguaaguuggaaaagagcuuucguuuuguuuuuagaacuugugaauuugagggacagcaucuggugaugaucacggcuggcugagucccaagacucaggcgguccugaggcaggaggucagggagcaugcgugaguccggaggacagggagcaugcguguggguuucugucuucauugguuuucuuuuguuaagcuagugagauucaacucuggggccuucuaauucuccuuacuucccaaagacuuuacccuaaauaccuuagcgguguguguguguguguguguguguguguguguguccacugucucagcaucucacagggggaaaucaguuucagcucacgaaaccugagggguuugcugaagccacacccaaaccauaacacucacuuugauuaguggguaaaaucaaaguuucacauugcuuuggucauaccccaaauaagacagccucaaaggcguagaauccagggaugccugugagacgugucuauuaaccuucaccuuuuccccguuuucaggacuacccaucucuggggcugaugacugagaaacuaucccagaaaaacauuaacuugaucuuugcagugacugaaaaugucgucagccuuuaccagguaauuagggcucugggcuucucucuugucaccauaggugggaccugaccccgguggccagcuccugcuuucacuagccagggacccaaccaggaaaaaaauccuuuuaaacucauucuccaggcugcuuacauuccucccuguagccuuuucccuucaaccucucaccuauaaggaaaccuguggugguuugcaauggcggcggaggugacucaguggggggagggguagaaaaagguuuuuguuuuuuaaauaauguuucuuagauaugaaaauaugcuagaucuguuuugguaguaacaaguaagauacuucacagugcccuccaaacuuaauuuuaagacugccaguugggcgguaguggugcaugucauuaaucccagcacuugggaggcagaggcagaggcagaggcaggcagaucucuugaguuugaggcuuccuggucuacagagcaaguuccaggacagccaggguugcacagugcaaccuugucucccaaaaacaaagaaagaaagaaacaaacaaacaaccgcugccagucugacgaaggaggaccugaggaggagaccacuuucuucaggacgcuguggacaucuuugucuuccuuucuagaauuauagugagcucauuccugggaccacagugggaguccugucugaugacucaagcaacguccuccagcucauuguugaugcuuacgggguaagaaugcuggcccaggaggcccuggugcgucugcuggacgaagcuuacucaucagcgcuuuuuaaaaaaagaaguacaagagggauguuguggucuacggcagaaaacagacacauaaauuuccuucaggaaggaaauuauaucaaaaagccgugcuuggaccugugggugggagaauauuagauacaaacaauauaauagggggacugaacauaauaggaccuuaaaggugacaagaggcuucccuguagagccugaagaggagcuucauuaagagagugagagguucagagaaggagagagagagagagaaaggagagagagagagaaagagagagagagaggaagacagagauacaggacaaacuuccaugauagcagugggaggggaggcccaaggagccucuccaaugagcaaccuuuaucuccaaacccaaucuucuugcugagucuaagaccaaucccuagaacaaagggaggcuccagcucuguauacgcuuuaggaguggcgggaaguuuccaaucauaugguuugguugaacaucacacacagagaagccaggagguacuauauacauugagaacagucaagucagagcacaaauugucuuggaacucucugucccaaagacagcugcagggacucaggcuguggggucacuccuaaaggugcaggcccauguucuaacagagcucggauuugggagccaucugccauucuccuguauggucuuacugcguuuccuuuaugcucccagagguagaugguggccagccuugggaguaaugaauggcaccuucagaaaugggccagaaaggaaggccagggaggaacaggaacggcauguggggagcuuagaggaggaggaggcugcaaauggggauucgaugcccaagaaugcagcuguagggcagagugagggaaagccaggucucagccacauacaaaagaggugaccgagcauagagccuccauggcagcaacugccagguaaaccucagggcaaguccaaggccacuggcuuggcuuuguguggauggacuuggcuuuugucagugcccuaaccuuccuuuacccucuucugcucagaaaauccgcucuaaaguggagcuggaaguacgugaccugccggaagaacugucacuguccuucaaugccaccugccucaacaacgagguuaucccgggccucaagucuugugugggccucaagauuggagacacggugaggugggcuaggggagggacugaugcugagacucugaccaugggccccgagaucugugugcauccugacccuuuccagaauuagguguuaggguaguaggguugucaaucuuugcccgugaagcuucggaugcuuaagguuucuagagcugccaaggaaaccuauuauuuauuuuuucuuaaaaugucuauuuugguuuucuguguuugcacgucugauugaaagugaaaauaucucuuaaccuaucucaucacccaggguaaugcuuuucuuuucucugccacauaaaaugggggcaguauagcaucuguggacucuugcugagcacuggcuguaccagguuuuauucuggcugaugaaaauccaucagcaaguggaacaggcaaaaguuccugcccuguugagacuuaagaguguaaauauucaucuugccccuccaccccccccccacagcuuucuugauuauuacuggguuuuuuuuuaauguguacgguuauuuugccugcacguauauuuguguaucacacauguggcugguacccgaugaggcuagaauuaagugucagauuccuuugaaauagaguuacagaugguugcgaucagcuguguggauuuuaacccaggucaucuuguuaagaacagccagugcucuuaaccucugagccaucucuccaguuccccugguuuucuuugcccguucuccucuccucuaccugguccaugggagagaggaaugaaaggaaauagaucuucugguccaguucccuauaaguuuauauucuaaacucacguguucacaccacacacaccgcacccugcaauaaaaugcuauacagcaaucucucaguuugcuauugaccauuguauagcaugguguggugcaaagcaacauuuugugugccuugcuguuauuauguaacaauacuacuuaacuccagcuagcauaguuggccaaagaaaguauuccccaaaucacagguucuguccugcuugaguugguuuauuucucaggacaaaaccaguccucuauugcgugucuguaacuguccagugagauaugccacagugguauuauugcuguguuacgccaguguagcuuuuacucuauagacucaauagaauuaaggcugaggaauuccccugggcauguggauuugacagucaauuaauuuuguuguccuuggaagguuacagcauagcauuuccucuggggcugguguuacacuuaggucugaaugucaucuuuccauucaggugagcuuuaguaucgaggccaaggugcguggcugcccccaggagaaggagcagucuuucacuaucaagccugugggcuuuaaggacagccucaccguccaggugaccuucgacugugacugugccugccaggccuuugcccagccuuccagcccacgcugcaacaaugggaacgggacuuuugaguguggggugugccgcugugaccagggcuggcugggguccaugugugagugcucugaggaggauuaccgacccucucagcaggaagagugcagccccaaggagggccagcccaucugcagccagcggggagagugccucuguggccagugugucugccauagcagcgacuucggcaagaucacuggcaaguacugugagugcgaugacuucuccugcguccgcuacaaaggggagauguguuccggugaguucaggcgucuaucugcuugcucaagagccaugugugcaugcguacccauagugccuugggagcaaguggagggcgugggguuggcaaggcgggcagaacugaggguccacugaauagaaaaacagaaaugagccggggacgggagcaguccuuuucccuuuguuccuguaagcuggaacaaguaggcagagucgagaaacaccaaggggaaguaguuuaucuugcuuuucugucuucaucucucucugauaauguugcaaguuccuaguuuuuuugaacuugaggaccaacaucuuugucaucuaaaaaauaucagucucgugguaguuuacagauggaugauguuggaaauauauuguaaaacuaaugauaacuuuacuugaauuuauuuugcuaucuccagggacuuaggaaguagugguauauaugcaagccauuggagguacuuagaacaguccuugaaaacgguaugcucauguuaaacauuaccccuguuuaucaucugucuguuauuauuuguauucugucucugugcuguccaagaugguagccaccagccacaugugucuauuuaaauuaguuaagauagaaaacaugaguucagcuuuccacugggccacauguggcuaucauacuggaccauguggguacugaacauuuugacauagcagaaaguuccacaggaugguguggccauaggaauuaccuaccugcagaugaaaaguguguguguguguguguguaugggugugugugcgugcauccaugugcacaagugugcaugugugcacgagugugcacaugcguauguguugcaugugugugaaugcacauguguguauauggcuauacagacuagaggugaccauugugugucuucuucaguuacucucuaccuuacuuuuugagacagggucucccauugaccccggagcucaccaguuggcuaggcugguuggucaguaagcuccagagauccagcuguuucugcuuugaaguguugagauuacagcauauagauuugugccacugagccuggcuuuaguuuuuaaaaccugaugcuggagaucugaacucagguccucauguuuguaacacaagcugucucuccagccuggagaugagaauuuugagcccuucaaccugcaggauucugaguugucccuacugugaaauucagugcaguccugaggccuauugguaacuucaaacuggccccugagaccauuuggauguguuuccgacaaagaggagccaaaaucauggucaauauggccuuuaucugaauacucuaagggcaaauggacagccugaguuaucuucuuaggcucuggagguagguuuauguuggaguguagcuccucuuugggacagacaggcugcaggcauuugcugguugcguuggcuggacugauucauguacaggaugcugugugaucaacagaacagagucuguuuaacuguuuucuguggugaucuaagacccagguggacuucauuugcauugagguucagccaauugagcugagcgacucaggugcucacguuaacacgguggcacaugccuguaagcccagcauuacagacugucaugaggagguccaggucauccuuagcuacaucguaaguuugaggcuugucaacacccaaccacuaccaccaccaccaccaagcucaauaagaaagauaaauaugccauguaaaaacaggucccaggggaccugagagacuacucagugguuaagagcguguacuauuuuuguugauguaccucacaaacaccuguaacucuggcccuagagacucgaacaccucugaccucuaaggcaccuguacucaacguacacgccgucaccauacacaucauuuaaaaacaaucuuuaaauuuaaaacaugccccauaaacauaaaggugauaccuuugcugaucuguaacaucguucacuucagugagggaaagagauaucacuauuaaauuagugauaaaauuauuaaaugauuaauaauaauaguugauauuauuaaauuauuauaucauuauuagauuagcuaaauuaguggcaagagaucaggaccccagugaugaaaacuggcgcaugauagcaguuugaacuagggugagaggcagggguuucagcucauuuuaauauuuaccaguauuucaguuaugcuguucuaccaagggcgcacccaaaggagcaagcugggagugcuggaugaggucggccuaggcaaggccuacaggagagccucagggccccuucaccucuucugggaugauugguucaggguguggucugggggaggggucccagccagccacccacuccacagagccuuggcaauucccaccuccugaagugucgaaaugucugguccugugugcuccacuccauucccccugcggggagggaggacuccuuuggaugccacacccauuuuacugcuccucaccagggugucuggugcccauugagccucaucuuguccuugugacacuguuaucacauccuuagggacacauguucauggagugcacagcacaugugauuccugaccucucagagccaauguccugcacaucaguguucuuugaugccugccuuggggucaucacggggcaggaguguuagcugugacuuggcuccuuccuagccuguggccucuaagcaugcagguggcugccuggucacccccccccccgcaucccucccccccuccccugcgcuucaggcuuggucuuugagguugcuuguagcucuuaccugucuccccucuaccucagacagcaugcuuccucccaggcucuuucccgccugcugcacacagaugggcuuccucugugggcugggccuuaugcuguagccacaugggaggaacagguaucaacagacaauuuuacuguuuauuaauauaccaaagugucugucucaucaggagucacaaccugcuagaacccagaagugaguuguccgcagagucccuagagagagugaaucaugggugggggacucgugggcagucucauggagguaaugucugauggaucuccaaggaaggcugguucucacaggaaaggaguggaauuguaagucagucuggaagucuggcuuuucagggagaguaaccauguucccucugacugaaaccccucuuccucuucucccacucuuucauuuuuuugcucccuccucuggcuuuccuaugaacccagccuaggccucccccacccacccuuuggcuggagagguaccaacacugugacauuacuagacugugguuuccuuuuaagggcugacucugccagggccuggggucagccuacuggcuccggcuacccucuuccauuuccacucucuggcuggcccagcagauccucuugucaaagaucacuuuguuuugccucacaaaggaaacacugugggauucagguucugcggagggcuguggcuucuucugcguccugccaggccucuguggcauccuccuuucuccauccaggaaccuggcuaaaagcaagcguaguggacaagguggagcaccuacccucuggcauccccaggcccagcugcugcucgggaggguugucugauuagagcucacagcugcucuuucuuuggagcugacaggauccgccuugcguucagaaguugaccaguggaggaagguugugcaagggcaguuccgcuuccucagagugggcccugcucuguggugccacccaugcuuccaaacucaccaugggcucaggcuggaaggaguuucuauccuagaccacauaccugcugugugugugugugucucugugugugugugugucugugugugucucugugugugugugucuguguguguguguguguauguauuagcauccauguguggacaucagaggauuauucugccauuccucaggaagugucuaccuugcuuauugucucagggucucuugcuaggaccuaguuugugagcaagccccaggcaucugccugucuuugccuuccugguguuggauuuacaaauacaagccagcauacccggcuuuuuuuuuuuuuuuuuuccaaauggguucuggggauagaacucagauuuucuugaccauggcaagcccuuuacugauggaucuauuucuuaagccucaauggcuuuuauauccuuuagagagcccagucucaagacuuaaaaguauuucugguucccagcuuuucugccagccccaacuuuauuucugugggcggcuugcuucuggucucaccuuuuuuuuuuuuuuuucuuccuuaaacaaaacaaaacagauuucuaauuaauuaaugucuuucaagacaggguuucuuuguauagucuuggcuguccuggaacuagaucuauagaucauguuggccacagaaauucacaugccucugucuccugagugcugggauuaaaaggcaugugccaccaccaccuggcuauuuuuuauguugcuaaaaugauuucuuuauuuuuaguuuuaugcucauugguguuugccugcauguauaucugugugagaggauugaaucacuuggagcuggagcuacagacaauugugagcugcuggggauugaacccgggucuucagaagagcagccaguguucuuaaccacugagccaucucuccagcccccuuuauguauacagguguucugugugccugcgugucuuuacaucaugugcaugcaguaccuguggcggccagaagagggcacugcauuucccuaggaauggaguuacagacaguugcuagccacccuguagggugagggacuccaacucuagccuucuagaagagcaaucagugcuguuaacugcugagucaucucuucagcccuaauguauagccuaggcuggccuugugaucuuccuuccucugucucuuuagcauauacugugggccccccuacaaccagucuguucuaagaaacauguauuucuuucuaagggaguacuguagcugaguuguauuuacguguuugagucuugaacgaugauguaucuaugagagggcagugcaggacuacaaguguaggggcccauagugcccaaaaagacaguggguuuaucgagagcagcgggugugaucuuguuaccaucagaguauggccguguaccacccucccuccccuucuuggagugacugaugugauuuucagaccacuaucugcuccuuaucuuucuuccaauuaacagucauauuuuguuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacauaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuuguggcuacugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuuuguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaaaucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcucaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcuugaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgagucuccagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucuccaacagucauauuuugaauagcuguccaguucuuccugaugcagcgcucuagagaacgggccacucuuuguaggguuuaguggccgacuuuuaaaguccuguuaaaugacuacaagagcaauccagcauugugagguaaaaccugccuucaauuggccugccuucccaugccagucucccucccaguccuacacucggggaaaugauuggacccuucacagcagggcuggcagcucauugcacuacuguaauacuacagcccagggcacaguugcuguauguauguguauuuuccauggauugagauugcaagcucccuuguagcacggaucuugucuggcacgcucacugcugagucucugguauccaguaugugguacgaggucaguaaauggguguugaguacgugggugacugaaggaacacuaacugucugccuacuccauaaaagauuucaugguaauccccacuaaugauaaagcuaacgugauaagccuaucgccuaccaagaagcucagagaaacccacaauaaagcaaauggccauagaguaaggguggauguacagcagccauaguguuccaggguggggguggggggcaccugagaaggcaguuggcgccaccugaacaggucacaaaaaguuagugagaggaaggaacacuugaguugggccuuaagggugaaucgggacuuggaagugaucgcaggguuaaagggagaucuagauagaaagaacaguaugaauagaaacaggcgcccaugaaacugcagaaggcugagcccuguccagacugggcccugacucugcuggccccacggccaguuacacaaccuuucugacacuacuggguuguaagagaggguaaggacauacagaguauggcauguaggcguccaugcacuucacugucacugcugagagcaacugauggcacaggugccagugggaagauuaaacuucccugguuuuagaaaguaacauaagucucuucucuaaacgccacccccccccaagcugcccuacugugcucucauagggugacauggggccacaggacguguuagcuacauagggugacaggacguguuaauuaucucugucgcugcuacaaaguaccugagaggaaugaagguggaaagauuuguucuggcccacgguuucagaagguccagaccaugcuugcuuggucccaaacgcuuaggguggggcagcauaacagcaggcacaugagguagaagacaguggcuggcuucauggccagcuggaagcagagagagcaagccaggagucguucagggagauaucuacuguacccugcaaggacccaccccugccccccgcaguaacucauucaucuagcuaggccucgcugcuccuuuacagaaucucucaaaauagcaucaccgacuaaaaguacaagcagacgagggguguacaagaagaaggcaggcuguaucguugagacuggaugcugccgaaccguguuggcaacuucagaaaugaaucgucaauguuucuaaagcuuugcggugcaggugcaggaagaguugaucagcagaaguuuguuggaggucuuugggcucugugaggugugguggaggcuuuugaacugugugggguuauggcuaaccagauuucugcuguuuuccucuggacacucucucuccucuucuuacccggcuuuucuccuuuucucuauggcauucacgggauuuauuuagcaguguuggcccuccgcggcuguaagguaggcuauauuuguuccuugugcuuccuuggccuguugguugauuccacaggcucucagugccuuuugucuggcccuuggguacccuaccccaucuaccuguauacacagggcacgaggcuguaccauucucucaucucguuccaguacacuuuaccaucucgugcacucucccucagagccuugcuucuuaccuugcaaggugacaauuagcugguuugagaaacacaguaaugggccuugguggcugguccauuauuuuguuggugggaagggcuaacuaguucaagucagagcccuuguugaugucugaccuaacagggagaagauaaugguagugaugguuggccuuucuugucauguuggagagggaacagucaugucagaucaaaagaaggcagguguaggggcuggagaagcccuuucaccacaccacuuugucaaaguuccugaaugcccugugugggcacaggcuauggggagcucucaggucuaaggagcuggcucuaauccucagacggaugcuggcagagaaggaggaaggauucagaacagggcaagaaaaagggcaggaagucugggagauguagaucugaauaguccuuugcuuucuggguuuucgcccuuggggugccuaaacugcuguuugucucuauggguuagagcucuucgagcaaugcgcuagguccccugcucaccugcaggaucacuguuagugugguggugcgguaauuuguuaacacacucuaaacucuccggugggugcgagugccuccucuacacccgccuaaauguuguuuugaauuucagaaugaaacacaccauacacacacacacacacacacacacacacacacacacacgaagccuuauuugaauaugcccgaagccgcucaaugcaauggcugggcacuuccaaaucuccccacgacuaacacacucuccccucuauucccgaguuauuacuuacuaaaaaucuacauucuaacuuggcugccuggacccaguugggcagcucacucaggcggugcacuccagguuccuucacgugacuguuggcucucgcuucuccaacucccaagcccgaucuuccugcuucccucucuuggcgauucuccagccuccuucuucccauggucucuugcccggaaaauguaagguccugucucugucucccugcccagccauuggcugccagcaacuuuauuuaccaauaagacccaacuggaggcagacauguggauuuccaugugauuuugggagcccaguuaacacaaauaacauuagaaccaacccauagguaugguugggagaacggggaagguuaguagccugugucauggggugggcuccucaccgcuggucugcugucuccuggcucuguuuguaggccaugggcaauguaacuguggggacugcgugugugacucggacuggacuggcuacuacugcaacuguacuacacgcacugacaccugcauguccaccaaugggcugcugugcagcggccggggcaacugcgagugcggcagcugugugugcguccagccaggcuccuauggagacaccugugagaagugccccaccugcccagaugccugcuccuuuaagaagugagugaacagcgugcagagacaugggaggccgggagaaggaagggggcccuggcggagaacucccaacucuggggaucugucuuagagaacuguuugccaaauggugcuuuccuuuuucccauggggaaguuggagguggcaccagcugugcagggaccaaagcagaaccaguuggagccagcccucuuccagaguggcaucucgaagcccucugcauggggagggggaucaaauaggacauucuaacuuuccgcugcaguguucugauuucuaugggaggugcagggggcugagguucuggugggccucaggugcagggggcuugagguucuggugggccucagugaaaugggcauguuaguacagagcugccccguucggacguugaggaagcgucagucagcacaagucuauggcucugcuguugccagguucacacaggucgugcccucugagcugcgguagggcccagggcuuagaagaaagagccucaugcugagauaaugcucuguggucacugucuugaaauuuagguauguuuggacagaauuuuaauuuuucaguggacucucaaaucacgugaccaacucugaccuuaaaccucugagaauuggugggaagucaccaucaccaucaccaacaccuucaccaucaccaacaccuucaucaucgccuucaccaucaucaucaccaucaucuucaccaucccuaucaccuucaccaucaucaucaccaucacuaucaccuucgcuaucacuuucaccaucaccaucaucaucaccaucaccaucaccaucaccaucaccaucacuaucaccaucaucaacaucucugaagaaguuuaaugaagucuauuuuuugauccuauaguuccagcagucaggagccugaggcagggguuucaaaaguucaagaccagguuagguucuguucucagauccaggguuggcuggccagguccugucugaggcgaggagggccucuucauuccugaaauccaugaugccuucuggguacauggcauacauacauacauacguagagcugucccugccuggcuuuaguugcuguguccucucuccucuagggaguguguggaguguaagaaguucaaccggggaacgcuccaugaagaaaacaccugcagccgcuacugccgggaugacaucgagcaggugaaagagcugaguaagugcagcgggucugaggguucacgugcccaggauaaacccaggccacacacaguucccucaaagcucaccagcuuccuuuuuccaagguggaagagcaguugccaccugaugugcaggccugauguguagugggcaccuggcgaaggcuggcuaccugggagucuccuucguccuugcaaauguguucuggagcucacaccuccugcuaacuggagccccaggcucagcacgugcaaggacgugcaagucacauaauucuuaguuuacugcuaaaggagaggaagggaaugucuuagguuucauagaugagaaaacuaggcauacaccuguggcugccgucccuagcuuaguaggcgaguuaagcgacacugggccugguggcacacgcuugugacccugucacucaggaggcugaagcuggugggucuuuacuuugaagccagccugggcuacagcugugaguauuccaggccagccccagguacagagcaagaccagcucucaaaaaaaugauuuuaagaaaguguuaagggggcuggagacauggcugcgugguucagagcguggacuucucuuauagagggcacggguucuguucccaguaccuacaugguagcuagcaaccaucuguaacuccaguucuggaggauccagugcccucuucuggccugcauggguacugcacacacauggugcacagacauauauaugcagacaaaauacucaaaauaaaaaacagaaucuaaaaacaguguuaaguaaugcccaggccuuugcuuauagcuuguugauuugcauggaaaccuccagcuuaugaacgugaccaugucugcucucugauagcucuuuugacuuuuuggacccccucuuccuccugaaauaagaccaaaguauaaacagaggaaucaaguuucuuauuuaccaucauucuggccuguacucugugcuguuuuuuaaagacaaucuuugcugcugcucucgguauaucugauacguugucugaguugagagggaaaggguggugcccaggagaugcuaaucucugcgcagauagcaaucaccuguuaggaggggaaaugccucuucaugugagggccacaguaagacaauuucaggcacaggaguuauagggauaucagaucucugggccuuugaucgcagaagugaguugcagugaggugggugguuggggguugaauucgaagaaguguuuuuaucuugagagaccaggccugcugugaucagcagggugcaaggauacaggggaggugugggugugugggugugugugggggguggggguguggggguaggagugaggguggggggaggguuucuuugaucucacugagucuacuuuucuucaucuaugaaaaagaaacuauggcccugccuaguggggagaguuaagugacaugaaaucgacaguugcuaacagagaguaggugucuaccgaccucucuucccuuuaucugcuugcccaacgguuuucauucauuuccugaugcggcccuugccaguuuuaccugucugcauccaucgguauauggugagauacacgcaguggagaguaacuaacccacagugucucccagugaccaguaggucucuguuugaggagggcugaaacccacaagcaucaugggagucagagacaggagauggcgguagagaggcacacacagucagaaagagaagcaaaaggacuggaagggcugcacaaaccaucugggaagcacuggggaagcagccgaaggaaagagaggggaggggacgcccgaccgcagugugucaacugcuauuuuaugcuguuuaaaucucgugcaacgagguacgguggggacaucgucuuucuuucauacaugaagguggucaggguagauaggugccagugcugauagguggcagagacaggcuuugaaucagaauguacaaaugcucugauagcacgcccugcucggaggaagaaauaagaaccagaaagggccaggggggaaagaaacuucaucacggagggccagucagugcugauggccgagcucgaccuccaaccucugugucuugccuagagucaggcaguuuccccgucauacacuuugcagauguccuaugggcuggguuuggggaaaacucuuaacuuucugggguuugauuugucucucauucuccauauucucccuuugucagcggauacuggcaaaaacgccgugaauuguaccuacaagaacgaggaugacugugucgucagauuccaguacuacgaagacaccagugggagggcaguccucuaugugguggaagagccugguacgugagccccgaggccccagcccugcccuuagggagggagagacgacccugcuaggcagaaauuucuccuuguaacccuuucaaacaaaacaggccaaagagguaagggggcucuauauuaaguacuagcaggaaggugacucaccggggcuggagagggcucgcaugguuaagagcacuugcugcucuuacagaggacccgagcuuggucuccaugaccaaggucaggugguucacaucuagcacgacucucaaccuuuauaugugggcuagcgaauagaaaugggugucguccucguucugcugagcgagcccagggaaaguggucaugggcagggcagaggggagccuguggguaccugugaaggaacacacguuacggucugagcacagcuuccuacucaccccugcccuagccugggcucucagcccuuugcuguuggcucugcaccucaccucaccucuuugcuacacaaucugcuggugaucccguuggcucacaaacccaaaucauuuggcuuaggauuuugagacugggaguauagagucaucugauacgaccaaacaacccggggucgggguauggucacuuuucauauucucagccaguacauccauuuaaaaaaaaaaaaacacacauugggaaaugggauccacaggucuagcgaccuacaggugcccuuugacuucguggugcuggaaguagaaccuggggccuccugcaggugcaguauuuccacagucggacccucagucggcgggggugggggggcacaucuccuacccccuggcucugccucuccuuuuaaccaguccccaggauuuccagggacucuagcugggagcagcacaggcagcugggguccugaggugcaggaagagauuauucucuuucuccucaccaccucauggccuugcagauguuuucuuuggacgacugagucaccacagggcaguaaagagcauuuccaaauggauucagccacauggaaugggcucucuucauucuuggcuaaggcugccagaaauaacaccauggguuccgugcaauauuuaguauacacacacgaaaauaguaacuuguuuaugggaagccagaucgaucuggacuuccuauacuuuuguuuacuacaucugcccacgcuacccaggcuugucuggcuuugggucacccacuggcuaagagggaccucuagaggcaccugccucuggucuccugccucccacuccuggugaugacagacagcuuuccucuagaauuccaccuguguugcccagaccacuaugugaaaauuucacuuugagguuugagggucaggccuaucccaagcuuucaaagaauucacgguuguuuuucccagaagaacuggggcccuuugcuccugguaauuuggacacuggaaccucacaagcuccccucaggagccccuucauuaucaagagguuguaauuugguggguugggaaauggccagagugguuugugguagcgguuguuuuuguguaguauguggugagccuagggugucuguuuagagaaggugggagauggaguggaaagugggugugacuucuucuccagacucagcagcacccauacaagcaaacaccuggucucaugacacuggaggcugccagugugaggucacuuguuagacacccgagguuuaugggacgcugagcucuuuagaauagaaucagcuggcugguggauaaauaucacagcuccugucugcuuugguuauuggcuggguagaaacaaagaggucagccuccaguaggguuaugauuuuagauuacuacauuaucuuggcuggcaggcuuccugguccccauggauguggagaagggcuguugaguuuacagcucucaggguuuuaaacaucugaaccagggcaagagaugcacaugucgacgggacaauaaaugacaaggcuagguaugagacaccaccagugacgaugguggcugguguuuaucgaggagucagcuuugugccaggcacuguucugagcucuuuaaaucuauuuagcucugucauuccucaucacaagguuuugccugugaaggcuuuguccauuuuaaagauggagaaacaggaaauagacacuuagaaaaguuaguuuauugaaggccagauaagcaguguaagcauuaaagccaguauucaaacccagacagucuuggcuccugaauguccaguggcacagacccaaggucaagccacacucugccugugcuuaggggacacuggggagaggacucugguaagcagaacacuaauguucugaauauaaaagagcuagcugcucccacugcuagccaguggcugcucuacaggaauguaaguuccaggauuagcagguguagggguguguguguguguguguguguguguguuugaaugucuguguguguuagcagguguaggugugcgugugugagugcgugcguguguacaugugugugcaugcgugugcaugugugugcguguaugagugucuguguguguaaugauagggauagagcccaggcuucaugaaaaauagcaagauguucaccacuaggcuuaguuacuccccaaaucgauuuuuuauuuaaaaaauuuuguuuuugagauuuauauuuaagagcaacuugccucacuggauauguguguagcauauucauggcugggugccaguggugguuggaagagggggagucaggugaucuggagcuauagaugggucugagccaccaugaggaugcugggaauuuaaccugggcccugugcaauagcaacguguguucucagcuucggagccaucccuccacacugaauggguuagguucagccggagaaccccgauuuaggguacccagggcagaugacugcuguccuaaagauuguccuuuuuaaaaagcgacgaacuuacuguuucugauggucccaucuucaacucugaaucccucuguuccgauuucauuccugggagucucuggugauuccugcucuccgucucugccucccagagugucccaaggguccugauauccuggugguccugcugucagugaugggggccauccugcucauuggccuugcuacucugcucaucuggaagcuacucaucacuauccaugaccggaaggaauuugcuaaauuugaggaagaacgagccagagccaagugggacacagugaguggcugugcugagcuuugaguucuccggagucuuugguucaugaacccgagguuggggcaggagaugcucaguggucagccagccucgaaacugggaaauguuuugacuguucuuuuaucuguaugugcuaugaggccucccaguccucuaccuuacagugaccacauguccugaucacugagcucacacgggauacuaugacaaagggagaagcuuaauucuccaguugaggggacagggcaaaucuguaucagggacauguaacacacuguacagaaagugacauagcagagaacgucuccugagggcuaaaugcuucugacacuuuaucuccguaacagcccuuuugauggacaauauuaucauucggauccuauaguuaaggaaacugagggcagagaaguaaagcagcuugccugacaaaggaagggauggggcaauacaggaaguacuuucggagucagccucuuagaugucauggccuuacaucuguuuaccucauuuuucucuuuuccuucaaaugagaggugguagcuugcaaaccaggauccucuggagaccccagaaugcuguuuaaccugauuuaauccaaucaaacgagcaucuaaacaacaaaagccccaugcauguguguauggccaugguguguuuucagaggucaggggacagucugcaggagucagguuugccucccacguggguucugaggaccagugucagcugcaucaggcccggcagcaaccgccucugcccgcucugcccgcucugccagcucgcuaguccgucgucggaugagcauuuuucuuugagaacuguuuauuuaauuuuaaguccaacuucacuuuauuuuuccuagacaggccaagaauguacagcguuugagccgcugaggaacuucucuagauuucuugacauggaggggauguucuaaauuucuugacuaccauuaagggggauucauuuacuuuuuguuaggaaguaauuugggaaaccuggugaaggcacacaacaggucuguggguagcaacuggcccgagagaugagauaaaaacaaguuaggaauaauuucagcaaaagccgggcucuguguucugaccucaccugcuacauuuucccuucuggcucccaucgcgggcacugccuuaaugaagggaaagaaagaguagggacagaagaagaaacgggagaggcagggcaaacaguauacuagucugggacugacaaauauucuuccacccaaagugacugaauuaaaaacccuuagaaacaguggcagaccagcaauacagcaucccucuccccuccuucucuccuaucuauucccauccuaagaguugaugaguaaauguaaacauuggcugauuucugagaugacguuuaaccguuugggguaaggaagugcauggagcugaccaccguuucuccucucuucccucugcaggcaaacaacccgcuguauaaagaggccaccuccaccuucaccaauaucaccuaccgggggacuuaaugagaccaucuucagaugacgccaggaccgugggacucucugccauuauguuuacagaggacauuuguguguguguggguguguggguguaugggugggauuuggggcguggguugggcugggcuggaagaaugucaguaugugggaauguaucucucuguguguacuuaugugugugacgaguguggggaaauguguaauuuaaaacuugugaugugucucacaggcagagcuccacagccuuuguccucaggggcccuccccaaaggauucuuccugcuuagcuugagggggacucaugaugcccggcaggugcucauuaccucugagaagcuagcuugcuuugucaggccauucucccagaagagaagggcagggcugagguuccccaacccccauuccagaggaaguggugucaagucuugguucuauaccaacuuuguaauuuuccgguucuuggggcugacugucaacagcugugguagaaagugcuugacguugaagcucagcuguaucgucugugccucugcccaccucccucccuuccucaggcugaugguggaguuaggggagaaucgaguccucaagaguugccuguggcuuuugccagcaccucaguccugcuauggcucucucucucauaaggaaaguccuugucaccuggcucuuuggccuguuaagggugaggauggcaaggccacucaggggucaugcauggccuggggggugugccagcaccuccaagaucauaaucacagccauucagaauugccucauugguagcucuucccaggagauuugugaacaugugucauugugucaacaccaucucuuaccuccugcuucuacacccugauggccacagacuugugcuaugugcugagacucucucucauggucagaugcuaugggcugaggcucucucucauggucagaugcuaugggcugaggcucucucucauggucagaugcuaugugcugaggcucucugucauggucagaugcuaugggcugaggcucucugucauggucagaugcuaugggcugaggcucucugacauugucagaugcuaugggcugaggcucucucucauggucagaugcuaugggcugaggcucucucucauggucagaugcuuucuccucaggggagagugcaguggucagagcuggagguccauccccacucuccaggcuuucugcuccucuuuccgggcaccuccacacaccucauccuaugccucugugugcuugcuacacccauccaugggggugcuuguguguaucuaccucuucggugucuugugaaggagucccccgagucucccaugagucuguugaacaacgugccagggaggaguugaaaggccagucagaacugcauguguggccuguucuccugugggcuggacaaccucauuuuaucucagccuuuaaucugggaggccacaagugcaauuuuauuuuauucccuauggggacacccaaaacuaugaugaggcccgaucacucuagaggagcacguauauaaacauacuugcauuauuauauuuauaauuuuguaugaugacaaaggagagcauaaaaaaccccacacagaguguguggcaaacauucuuaguaacuugccagucaguggcugggucugcaaggggcuucccucuuccuggaagcaugugaagauggguauguggacacacugacccuuucuugaagagguuucucgacuggguucuggguucuguuggcccagcaagcaugguuugcucugcuggcauugacuuagaucuaauguuaaaaaucagugcuuaccacccagagacaagaggccuauaaacagcaucuugaugaucugagaccugaguccuggccucgggaucgcugucaaaacaccugaaaguuaauucagaaaagccauuucccccaccccucuggaguucaauauucuuuuggauuugguaacuuggaaagucuauuucaagugucacuauucuuuuuuucugaaagacagggucucauguaucccaggauggcuuugaacuugcuauguagccaagguugacuugaacuucugauccuuuuucuacacuucucaggugcuacaauuacaggcaugaguuauccugccuggcuuaugcagugcugggaauagaacccaggacaucacacaugcuaggcaagaacauuaccaacugaucuguauucccagcuuuaguaucaacauccuaagaugccgagaguaaauacgguaucaagccugcgguccagauucuguguguguauaaggaggcuggaauguugaccaguaguagaacaagcaguuaaggaauguccuggguuugauucccagcacugaaaacguguguguguguguguguguguguguguguguguguguguguguguuuuguggggggagaggugguguugcuccuguuugucuuucaguuuccagacugaaugccuuggcuuucacgagagcagaugcuauucuuagaacuugucucagcgagucucauuccuucucagacucccuucaucuuuuguuagugggugcaucugauguagcacuuaguuuuuauccaacuuguucuuucuuguucacucugcauacaguugcaucugcauaccagggaggaccuucaguaaggaguggcugauccagauguugguguggugagcaggccucgaguacaggagaaagccagcgacuguccgguugugcccuuggguuacucuuggcuuagguggugggaguacaguagagggacagggaagauggucagagauccauccuuuagcuacugaggcagaguccgugagaguagagugggguuuucuuuagagaagacuguuuagaugaggaaacuagcagggaaggaagaaaauguauuagaagagugaaaggugaguaggaaucuugacgguuucuggaaugaggcuuguggugcuugggcggcaacgccggucaggacucgggcauaucuguagcuguucucuccggaggcugaggaacagucugagugguuuccaggggaugaacaucuaaaauugugcugggaaugaaugcgcagcacagagcggcugggcccguucucuuacaggugguuucgguccagucucugucugaggacaacaggaagagacagagaaugccuggcagguagcucuguucccguucuuucccucagagacagucauucugaagcugcccacagcaacaucagagucuuuguccauuuuugguugaaauugcuuacgcgccuuccugacacccuccccaccuccucugaguuguguaacagagaauuaaaugugcuuuccaa

SEQ ID NO: 12491 - RNA, 61065 nt, Mus musculus
uugguuuccagcuauggccgccauuaccugacaaguaccagagcuggucucugcgcgccuggagagguugucagaguuguuucugcuuuucacacagcaggcuucuggucuguggcaggcaagagaauucugccccugaggcauggccggaagacagaacuagcugagugcuucagucugcagaagucuuucaggauucagcugaggugggccucagucggcagacaagaugcuccuggcucugggacucacgcuggugcucugugaguuucuaaccugcuuccuucuucccuucuuaugagacuugaauucgugaaaucaacagauuggcuuucuuuuucuuucucuuccagaugcaagccuccaggcugaggaaaacuguaaguccugguauuuucacauggcuuccuucuuugugucuuuucugaaauuaacucaugucagacugcuuaggguugguguuuacaacaacuaagaaaacucucaaagccuuguucuaaaucaagguucaaagaguguguauuagagacagcgguguaggagaaaauugcugaacaccagucuuacaucuugguggguuucuguuuguuggaaugggagagauggguuuuuuuaaaaaaauuccuuauauguauauauguauauauaugauuccuuauauguuuguggucuuucugucauaagcuauuucuuuuuacaucauacuaugccucuaauuguuuacuuucaaacucuucucuuuauucgcuuggauuuagagucuguaaucccaguacuuggaaaacagacacagaaagaucaguagugaaguccagcuucggcuccauaggaguuugagggaggccugagcuacuacgugaaacaguacaaaaccgacucccaaaaaauaaaaacuuaaaaaaguauuuuuuuuuccuuucacuuguuuuaauuuacaaaugagacucaguugacuugacagacuauggaggcugaaggagcagacaguaaaugggugucaggacucccucuguccuaagagaguaacaaaaaggaccagccagauccccuuucccucccaccggggaggcuccgcuccuaucugagcuugcuuguggggaaggguucugccugucuuuaaagucagaccuaucauccacucgagagcugauucggaaccuccgaauuuuucagauuaagaggaucugucucgcuccguccaucagagacucugaaggaagaggcucagcccagcccagggauugugggucaggaagaaggccacagauuacacuggcucagucaaaaguuauuccagugugggaagacuagggaugcugggcugcaggcauuuuugagcugaagaacgugacagggcugaguugagccagggauggagcuguggccccaggguggggagggcuguggucugugagucugugauuccuuaggcuucuggcucccuuggcaacaccuggagacagacuguguauugucuucaagucauccccacuaaagggugggaugggugagccucagaaagacaugacucagccuagaaugucagggcuugucagcacuacggccuccgcucccuggaacccagacaucucucuggggcuugugcuuggcuuuacuuagcuugcucugguuggggacuggggucucacacugcuaagguagucuugaacccacuguguagcccgggcugccuagggacuaacucuaacuccucuugccuuagccuccccaauacuccccagccuggugucacucagccggcuuggcuuugcuucuugggaccuuuuuccccugacuauaaaauggaaaccacccacagaccugguggcucgagcaggguaaaguugagauuggaguaagggaggaggagucauuugugcugucuauaggauuaguaaaugaucccgggcaaucaccccagcccuccuuuauaguuuaaauuugugcccuauuugcucuguacccuuccgugcccccuauccccacuccaucucucucuugcccucagggugucauauaccugaaacccacuguguagcucagaugacaaugacuuucagguccuccuacuuuccucucccaagggcugagauuauaggcacacaccacaccagguuuaugcagcacuggcagucaaacccagggcuuuaagcaugugaggcaagcacucuacugacugaacuacaucccagcacucucugucuccugucuggguucugcccugccagcccuagaggguucuugcaucucaagauccccauagcuugucucccaucucugugucugucucugucucugucucugucucucucucugcuucacaagacaucugcuguaagaaacauggcccagagaagcaggcaauagacugaaguugcuuuguuggaacuggaaggagccucaaccuuccccagggaugaaggaugaggggcuggggauguguguguguaugugcacacguagugcauauguaggggugcgugugugugugugcauguguguauaugcaucacuaccaggaaguuacagcuauuuuuuuguaguuggacuggaagcaggguggguucuuuuugauacuugggcaccuuguuucugcagguggagcugaccagucaggcuggggcggagccauucuuuauggcuaggacuauugcccagugcagccugacuuaauuccucauggccugaggcuauuauauaauauauucccaaauaugaaaggguaaaaagaagaaggggguggagcugggcaugguggcacaggccuuuaauccuagcacuugggaggcagaggcagguagaucucugugaguuggaggccagccugguguacaaagcagguuccaggacagccagggagggcuauuacacagagaaaccuugucucagaagaacaaaagaaagaaagagaaagagaaagagagagagagagagagagagagagagagagcgcaaaggcagggguacagagggaggguuguaguuuugggagggagggcuucuuccagcuagaguggggugacagucccagugguggaaggagcaugcuaaggucccuuccaggcaagauagugguuaguaguuuuuagccaugaagggccgagugacccguugaaagaacuuuuggugagacaguugaaaagacagagaccaaagagccaaguuaguacaaccauaaugauugagucugccaagggggugaccauggcccccaaguaguccagguguccucaaggaggacauugcuuacccuuccuugcuguuggagucuuucuaggaacuguucaccauuuucccauaguacaccauguugguuugcuuagaaauagccuucuuccccugggaaggcacagaugccuugcuuuggaaggcaucauuaagccuagucauccacacuucuggaggacacugcagccaguguaucuauuugauuuugguaggaugacugguuuguuguagcaagauuaggucuuccuuaauccgauugaucauuugaggguguugagcccuaucgcuugccguagcgagcgagccauugggagggcuuuccuaggaccucuuguuuuaguagagagggaaguucagagcguaaaaauacuuaaaaagaguucugugacggccaggguuacacacagagaaacccugucucaaaaagaaggggggaggagggagaggaggaagaaaaaagaagaaggagaaggagaaggagaaggagaagaaggaggagaaggaggagaaggaggaggaggagaaggagggggagggggagggggagggggaggaggaguggaaggagaaacuagucagugcuuuggugaucaccuucagccuucgaaggaaggugcugacaucccuauacagacuagaacaaaaaaauugcagccugugagugaguucaugggggcuuugagaugggaagggccccuugauuaguuuagagaaccauuucccucuugcaucagcuccacaagguagaaguaggccuaaugaggcgccugcugaccccucugaucccugcuauauauauuuuuuuccaucuaggccacugagauugagcucugcagggucaacccuagggauaagcaagcaagccagugucuugcuuccuaggcuacccaaguggaguaugugaaauguagguuuugcaguuuuucuaguuuauuuucccccacucuacaagucagguucuugcuaagcguaacucuuuuuuucucaggccucagguccaccucagccugccucugccuggagggaacucccuggacuucccgccuaguccuggccacuggcuaaucugccuucccacccauccugcuggcucccucccgugucagagcgcaggcacauucccucaagcugaccaggccccugcugggccaccuggaccugagccuauaccuccuucaccacaaggacccccagcccuggcccccaguuacuuccacucucgguggaccucugaagcuaguuuagaauggccaccucugcuuccucuggucauggccucucugccuggaaucucagcuccaccaaagaccaccugaugccaagccuuuuccaucccguaacuuuugcugcccuugucuaaagaucauaaggggauccugcucuccugacuaaggauuuccuuccguuuccucucccucguaaacccucuuuccuugcccucaagggagacugguucugcccagccccuuccuuuccugucucuagagccuccggguuacagugucuccauagccagucucugucuucugcaugucuccgucauacuggucucuccccugacccucaggcuuuaauccugagccugcaguauguuuaucugccaggccuucagauuuccccuuagaagcaaagccuuccuuuuucacucuuuuaccugacauuaucaguagccagcaaacugucucccauuuuucaggucccauagucaaucaaauuaggcauugaaaaguugugguaaaauauaaucuaaaguuuauuuuuuuuuaaaucuguauucaucuauuuauuuuugaggcaaggucucacuauguagcccuggcuauccuggaacuugcuuaugcaggccaggcugggcuggaagucagagaucugcccaccucugccucuucagugcugggauuaagggcgugugccacuuugccugccuuuaaaauauaucauugacaucuagagcacguacagccucguauaguucuagaagguuuccaucacucuagagaugaagcccuuucgguucuuuggagaacucucuuagcucagcccaccugccugccccucccccgccguuuccaucugauccgccccuggcuacucacuagccccuggcugcucacuggcauggagucugaggccauggugauuuuucuagaacuccgguaacuucuggcauuaccauccugacccaccugaccccuucucucccacacuccgcuccugaaacuggccacgcccagagugcacagguguuuuaugcuccuguuccugauacacgcuguucuguguucuggaguacccaacagcuggccugccgcuggcccaguggacucgauccuccccuccccccgcccccgcacauccagcacgcaguccuugcccucucccgggcaaucccuuccucucugcauaacugaguuauagccaauuauccaccagccugcgcgcucaaacagcaggagucauuucuuauuuuuccuggaccccccccccccccaguacccggcacaguuggauaaaugucacauggcugggaacuugaagugaacuuggagaugccugagaguccccagggcagaugggccagccuguccugugauagcaaggaagugccucagggcuuccaaggagcucuguaauuuuccugacaaugguagguaguuccucuuccccucugagucauuuccagguugagagccagguggcuggggguggcucaucauacuaagaggaccuuaauuugggaaggaagcccccucauuaaaccguuaguauuuaacauuguuuguaccccuccuccucccccccccccaaccccccagacaggguuucucugugaagcccuggauguccuggaacuccaguuuguagacccuccucucuuagaucucuuuaggcuguucugugcccuguuggccauugacuuuuuugaacaguuugaggcuugaugaggagcauggggugggggugggggcauuguccauugacaggaggucugugggacauuuccaauacugugcacaccuagagccuugggcccccccuugccgugaauaguccuguauccuggugagaccucugugcaguuucagugugcuucuccucggagggcauguucuuauagcaaggaguaagaauucuguuuuauagacauggagaagucucaagaucugcuggcuguauuauuauuauauuauuuucuuauagcaaggaguaagaauucuguuuuauagacguggagaagucucaagaucugcuggcuguauuauuuuccuguuugcuugauuuugcaaaaucaaagaccaaagaacaggacuggggauaugccucagaguucaucuggcauguguggcucccugguuuugaucccuaaagccacacauggugguacaagccuauaacacuaggacuugggagauagagacaggaaaaccauaaaguucaaaauccuaccuaauccuuggcuacauaguggguucauggccaguuugcucuauagaacuauuccaggacagcacagagaaacacugucgcaaacaaacaaacaaacaaacaaacaaacacucagugcagugcuuccucagagagccgaaccugggagguuggacuuucuagggcugccaagguuacagaguggggagugcccagccaaacucaguaucuuuguguuaacagaaaaugaaaggggcugggagaggggugugccagcucacacuguaguccccguacuugggaaaccaaggcaggauugugaagaguuuaaggcuagccugagcuacauagcaagauuaucuuaaaauaaacaaauaucuuuuuuaaaaucuugaauuauuccaagacucuggcuggaaguaguauaaacucagcaccucacccagucuuguggguaacucuggcucacaaucuugugaugauagacccuuuuggucaaggucaaaguuguuccacgaaggcugacuaagccugggugucugcuuuugagcugacuuuuguggcuacacugaaggccuccguucaucauccugugagacaccgccuucuuagcugcucuugcaggaugugacuuuugacccagggcugagguccuggaggagagagcuugacuagauggaagcuguacacuaacaucaggaggaguguccuggcuccauugggggagucaguccugugauagccuugguauggucaugugggagauguaacagggccgagggcuguuuuggaggcugucuagggcagagcggcugccacguuaucgaagcugguuauguucuccguuagggcuuggccuggcucauuugggaaauuuucuuuauuuaaaauuuugaaugcauguuuauuuagugugugugccugagcuugugugcagccugugaggugcuuuuagaggucagaggauaacuugcaugaguuaauucucuucuacccuguggguccugggauuccacaaacucaggcacagcaguaaguaccuuugcuugcuaagcugucucaacggcccuauuuuuauuuuuauuuauuuauucuucauguguauuagauggucgugagcugccaccaugucagugcaugaaauccuaguucugcaagaacaagugcucuuaaucaccgagccauuucucuccccgcacccccaucuccccuugaggcaggguuucacuguguaauccugccuggccuggaauuugcauuguagacccagaguggccucaaacucuuggcaguucuuucuucucugcuuccggagcgcuagaauuagaggugugugccacagcaccuggccucuugaguuuucuacaagguuucccccucuuccguccugugauacuccugcuggcugaguggcgacaugagguuccucccagugauccaggugcguguuacacaaguggaugugugucaaagaaaucagccgugucaauaccacccuccuuacaaaagccacacauuggcuggagagauggcucagagauuaagagcacugccugcucuuccagagguccugaguucaauucgcagcaaccgcaugguggcucacaaccaucuguaaugggaucugaugcccucuucuuguaugucugaagacagcuacaguguacucauauacauaaaauaaauaaaucuuaaaaaaaaauccacacaugccaagugugguggcacaucucuuaaucccagcacucaagaggcagaaacagguggauuucuguaaauucgaagccagccugaucuaccuuaccaguuccaagccagccaagauagugaguugcugucucaaaaacaacaaaaagccacacuuggugcuuuaauugagguuuuuuuguuuuugguuaaaccuagaggacaguucgaguuugagaaaaaugacagaacagccaaauuauaaaauuucaggggaaugaaggagagagcaagccaugccuuuugcaaugggggguagcgggcagcagcgaggcagagagcaugggggccucggaggcugaugcucaggguauccccuuccagacuuugaucacuaucagggggaagaggaaauagaaaaggagggaaaugacaaggccggaguuguagggugggaugcuucagauagcugcucacagcugccuggaggccggagacuuccuuucaaagaaagacaagucccuucuagcaugucuuuauuuagguggaaccgaauucccuuuggggaagcauuccugggauuccaacugaugaacugggcugguuggauugacaguagggaagggaagauagggauggcacaagaguuaagaguucuuacuacuuuugcagaggaggggugcccagcagccauguugggcagcuacaacugcccauaacucuagcuccucuucagggaauggacaccccuuucuagucuccuuggacauugcguuaauguacauaaacccauaugcagaauacacacaugcacaugauaaaaacgaacaacggaaggaacaauaguaugaacaguaacaguauguaauguuuuguuugaucuuaauucuuuugcaucuauuaugaagugggggggggggcggagggcguguuguugacccacucagcacuguggacagugccuggccuggagaggccccuguaguguuuccuauaguuguccugcaaugugaaggagagaagugauuauccaugaggcccaggguuuguuauuaccacgggcaccuugccucagucaccaaaaaauacggagguaggggaguggggcuggguaagguauggcucaguggccaagugcuugccuagcauuugaagggcacuggcgucaauuuccuagcaucaagagaaaaauaauuaccaagaaaugcagaugugcuagcauuccuguuucaacaaauagaagcaaaaagacuacaggaauuaaaaauaaaaaaaacaacuacuuccaaauagccaggcuuaguggugcacaccuuuaaucccagcacuugggaggcagaggcagguggauuucugaguucgaggccagccuggucuacagagugaguuccaggacagccagcgcuacacagagaaacccugucucagaaaaacaaacaaacgaacaaacaaacaaacaaacaauaauaauaaaacaacucucaacccuaucuagcuaaaggagacuguucaggaugcugucuguacaguagcccauaacuaggguggagaccacacaguaugagcaagucugggagccuaaagaacuuaccaauuucuuuauuucuggcaguccugaggaccgagccgaggacuuuaugcaugcuagguggguggucuacugcugauccacauccccaguuuggagacuauguuguuacaaaucguucugcauuuaauaaauuucuagaaacagagaagagaugaagcuuugaaacucccauuuauucugugacagauagaccccagguaccauuucccaggcguuuuccuggugcuaagaacgaugcugugucucccggagggugugugaugcuugccaaguaugcuacacucagaguuguagguucacuccucagcaucucauaagccaagugugguggugccugcccgggacccaggaggauaaagggcucggggucaucccucacgacagacaggaugcaagucugggcugagugggucccacugcugacaacuguggguugaguaacuaacggcccuucccacagcagagcuggccuguggccgcucauuuccugguaagaggucaaaucuugagaaugucucacugggucguuucugaauuucucuauuuuauguguguaugaaaauccacagugaauaguauagcauaauuucaucauuucccuguuuauauucauauaaccucuuggaggacauaaacccaugaaaccuucacaaagaagcaaacagggcaugaacagccaucucugcuuugagaaguugguacauguggaaccuccaguuagaugcucuauuuacacaacaacaaaacccaaccccaccccgagaggggggcucauuauauagccaaucugaccuucgacuucucccacugagcccuggccuuggcuuuauguguuguuguugguggugguguuuuuguuuuguuuucuuuuuucuuuuguuguuguuguuguuguuuuucaagacaggguuucucuguauagcccuggcuguccuggaacucacuuugaagaccaggcuggccucgaacucagaaaucugcuugccucugccucccaagcguugagauuaaaggcgugugccaacaccgggccggcuuguuuuguuuuuugaggcagggucucaguauauaggccaggcuagccucagacuugguagcccacugcugaccuugaacucucagucuuccucccuuaaccucaccaguaacucagugaaauuagagaacuuuuggauccaagcaggagacaaccaaaguccguuggugacuucugaggauucggagucucgcaaugagucagcugugcucacuggccuagcucuugucuagcgcugggaaucccagcucucagguuuuauuuucacuaucucuuuuccuggugcuggaguggaacccagggcucacaugcggcaagcagauagaaacaugcccucuucuccucucuaagacaauuuugugauuguuggguuuuguuuguuugaggggggggcucuguucauuuguuuaccacuauguuaaacuguuuguguguguguguguguguguguguguguguauguguguguguguguuuguuuguguagacaggguguuaguuucuucuuuacuuucuuuuaaaaauucauuuggaggaggacagcuauuccacacguaugaaggucaggggauaacuugaugaugugggaccucuccuuucaccacuggcuuccagggauugaacucagguccucgggcuuaguggcagaugccuuugccuggugagcccucacacggucccuuuucguuuuaaauguagugcuggggauuguacccaggaguuucauugcggauguuaaggaaguacucuaucaacucuguccccggccaggcaggguuuuacuuuguagcucaagcccuugaguucacaguaugguagucauggccuauggauaguuuccucuuaccagguaagaacaggacuuuuagagagccuuaucuaagccauggaacucuauguuuagcuggcacaacuucucuguaccugucuuguuagaguuuaucacugcaaugagacaccgugaccacggcaacuuguaugaaggaaaacauucgauuggggcuggcuuauuagaguucagaagucuaguccauuaucaucauggcagggagcauggcugcacacaggcagacauggugcuggacagguaccugagaguucuacaucuggauccacuggcagcaagaagugagacugaaccacugggccuggcuugagcauuggagaccucaaagccccccccccccccccaaugacacaccuuuuuaaacaaacccucacccacuguggggcccugaaagccaugcaaccugcugaacucuucuggaguaagagugagaucaaaauucauucaaaacccaaaaaucucaucccugaggccaccaggagcaggacugcuuccucccugcucugggcuaacaugucuaggcaguguacguagccuugggaccccacagucuacuccagcgaggccucaccucuuaauggugccuagcaguaccuggcaccuaauaccugauauccuccaccaucucugguccuugaauuucucacagccacaugcauuuuggguuuccccuggucaacugcuaggcuugaaggugucagucacccuaugugugguguguagcaugcuaucucuuguguaaacaggccagaggaacuuccucuuuggguuuucuuauguguacauguaugcucuaugcucacugggagccuccugccucaguuucccaugugggauuacaggugugagucagucacuacgcucagcuucaaauuaucuaaaaauaaaaucaucucuaguuguuguuguuuuuuuaggguuuauuuauuuuauguguaagaguguaagccuucaucugugucucuguaaaccuggccuagugaugcacgccucgauccccucauuuaggacaccgguucucaacuuguggggucaagaaagaccccuucggaggucgcauaucagauauccuugcauaucggauauuuacauuaagauucauaacaguagcaaaauuacaguuauuaaauaauaaggaaaguaauuuuaugguggugguggaggguuaccacagcaugaagaacugugucaaagucgcagaauuaggaaggaugagaaccacuggcuuaggagguggaggcaggaagaccagaaguucaguauauaaguuauguauaaugaguuagaggaagugcuaggcuacaucaaacucugccuaaaaaauacaauaaaauaaaauugguuccaagucuuccccagcaggcgacaccucuaaagugggucuguguccuccccgccacuggucacaaccucuuggggaggcagauguggagaguuugacugcccuuaucccauuccagugcuagggugggugcucagagacaucgcucuggggugggaaagcacagucuuaaaugugggaaugugggaaagucggagcugguuccaucccuggagcaggcaggggcugagggggucuucugacucuuagacacccaggcgcugaggggaaugaaggaggaacugagaacugagucaggggcccucgggcuggggacagugucuagccugggguggaagugggggugggagcacuggcuuaucccagcgguguuuggaggcgggcuugguggcaguuguggcuagaagcacggagaggccuucugugguagaauuaagcugugcguucauagucaaaugucuucucugugguuccccgaguuggaucuugagggaagagacagucugugguucuaaacaguuuauuguuccuucauggcaaaaaaauuagauacauaauauaccaugcccaguucucaggguggaccuuuuacagggaggaacgucugggaagggaagcugaguggcuaagcccucugggccucuagguaccucauuagcauagagagcucuguuuugggccuaggugacccuuggacacguuucuuuucugugaggaguguguuccaggccaggagucuggcagggagcgggaagucaccuaagccuccugugugugccuacugagucuccgggucucaaccugcucuaccuucucaaacuuccugaccagguuuuacaucccacacucugaggccacucacuaaauggcaaacaccuacuggcacaacccagggaguuuauuguuuuuaccugcauacgucuauuucagguaaugacuguccuuuuaaagccuguucuuccccccccccccaaggugcuuucugaaaccacagcauacauacgugaucucugaccuauauguccagccucaacauacauuuuuuguuugugguacuagggacugaacccaggccauuuuccaugcuaggcaaacacccaacccgugaaaugcauccucggcccucccucaacacaucuacuugucugucugucugucuauuuuaguuuguuuguuuguuuuucuuugguuucucgagacaggguuucucuguauagcucuggcuguccuggaacucacuuuguagaccaggcuggccuagaacucagaaauccgccugccucugccccccaagugcugggauuaaaggcgugugccaccacacccggccagagaaagcauuuuuaaauguuaagaagguagagagucaaaauaaggcaaaggaagcagucuagugugguggcacacaccuuuaaucucagcacuugggaaguagaggcagggcaaucucugaguucauggccagccuggucuucagagugaguucuaggacagccagggguauugggggaggagguaaaaaaggaaaaggaggaagggaaagaagaagggguguaggaggggggagaaacagggacaacuagaaccaugggugaauauuccugggcaugucugacuuuaugacagagaaucacuguuucuuaagcaacuacuguguccuguguacacauguauugcaugcuuccuggccacaacaauuuaagaaauaacuccuuuuaaaaaaagacuuauuuugugugugugugggggggaagauauguguaugguguguguauauauaugcgugguauauuuaugugguguguguguguguguguguguguguguguguaugguauguaugguguauauauguaugugauguaugugguauauauguguguguuauguguguauggauguauguuaugugugcauaugugguaugguguaugugugugugugcuguguauguauguguguguggucuguguguacguguaggguaugguguauguguguauaugugugugguaugauguguguggguuuguguggugugguguguguguauaugugugugguaugguguguguaugagggggguauguguaugguguggugugcguguauaugugugugguguauauguguguggugugguauguguguauaugugugugguguaugccuggguccgugucucugagcgaugcuguuucugaaguaacagugucugccauccuucugcuuugccucagccuucaccaucaacagcauccauauggaaagccugccaucaugggaggugaugaaugggcagcaacugacccuggagugccuuguggacaucagcaccaccucgaaaagcaggucucagcaccgggugcuguucuauaaggacgaugcgaugguguauaacgucaccuccagggagcacaccgagagcuacgucauuccucaggcucgggucuuccacuccgggaaguacaaaugcacagugaugcugaacaacaaggaaaaaaccacgauugaguacgaggugaaggugcauggugaguccgcaagcagaauagcagguugaugaugaugcucacguuggugacgcuggucacgccgcucauggugacgccagagaccggccagugaagcugguuuccuucuccgcuaagcuccaccuuuccuguucacuaccuggcauccugaccugaaacuguaggcuuuagaaacucccgcugugugaagacaggacuuccuccuuugggaugauguccuggccuugggaacacccuuccucauccuccuuaaguaauagacuacaucucccaaccccuucucugaaacagucucccuaaagcccgggcaggcuucagucuccugcgcaugcgcuggcguuacgggugugggacuccacaccccgcuacagaguucuucuugcacguucucaacagaguugauuucucccagggcaccagucuuuacaguguuuaugcuccucugugagagugacaaacagcaugguuuugucacaugaaccaaaccuuggugguacacaccuuuaauccuaguacucuggaagcagaggcagguaggucucugugaguucaagauggccuggucuucggagugaguucuagaauaaccaagcuacacagggaaacccugucuggaaaaacagaacaaaacccacuagacucaagucucucugcuuuagucaccaucuggauacguccaauagccauucuaaacuucaggggccacagagguaccugggagauuaaaguuauugcugucaagccugccaaucgucauucaauccccugaacccccauggcagaaggagaggacugacucccauagugucccaugaccuccacaccuacaccauagcacucuugggaccacacauaagacaccaaacaaauaauaaguaaaaucuaacaggagcauuaaacucuggaauccgcagggaugaagugaaauagcagguagucacucagggacucggcaugauugagugcaguucccugucuguugguguucagccgcuugagguacaauacuuaguccauggugaacaacacaggucauagugggcccaugagguaaacccacgagguaaccucgugauguuaugccaucuuggucugugcaaauuuacucucuuccuggaaugaugccaccucacaaagcauuucccaggcugugucuuaguuguugugaaacaaucuguguccauuuccccacaucuacugcucuuuggggcuauaaaaucucagagagauuaaauuuggccuauuuccagacaggcagagguuguuggaaagcgcaugccuuuaaucccagcccuugggaggcagaggcagguggaucucugaguuugaggccagucuggucuacagaacaaacuccaggacagccagggcgacacagaaaaacccugucucaaaacaauggcgacaacagugaccacuggccuauuuuucauauccuggguaaagacccaggcuugagguaggcauucaauaaguugcaacagaggccagagagagcucaagccguacaaagcuuuccacucagacuaaagacaggagugugcagacacccaguauccacggccugggacgugccuguaauccugcaacucaggguguggagagacaggaagguccuugggguuugcuggccauucagccuaguugaauuagugagcuacaaagucagugagagauccaucucaaacagaaagguggagagcagcugaggaagauguggccucuacauggaaguguacacacacacacacacgcacgcacgcacgcacgcgcaugcaugcauauagacagugaaagcaucagcugaaguaacauaauuaaauacugacuuuuuuuuuuuuuggagacagagucucacuauguagcccuggcuguccuggaacuuacucuguagaccaggcuggccucgaacucagagagcucugccuguuucugcuuccuaagaacgaggaugaaaaggugugcaucgccacaccuggguuuuuccuuuuuaaacuguaccaguugggaaucuaguugcaccaccuuccgaaggggaucgcaaaccauugagaacacuguuguauuauaguuuuaaacugucugcuacagugccaggcacacagauccccugggguagguaagacugaaucuucagggaauaaagggcccugaugcugaucagccacagugacagaugagggugauggggccguuaugcggaauugauccuaaguguacuuucuccuucuccaaaggcguauccaagcccaaggugacacuggacaaaaaggaggugacagaaggcggggucgugacggucaauuguuccuugcaagaagaaaagccaccgaucuuuuuuaaaauugaaaaauuagaaguggggacaaaguuugucaagcgaaggauagauaagaccuccaacgagaacuuugugcucauggaauuccccauugaggcgcaggaccacguguuaguguuucgcugccaagcugggauccuguccggauucaaauugcaggagucagaacccaucaggagugaauacgucaccgugcagggucagaauccugcccucuauaccauucuuuguagugacggguuauauguagccaaaaggagcccagaauuggagaaucugcgccuccuuuaaggcuguaaucccagcccuggugaaguacaggcaggggguucagggguucaagacuagcagcccucagcuaggcagugguggcgcacaccuuuaauccuagcacuugggaggcagaggcagguggauuucugaguuugaggccaguugaggcacucuggucuacagagugaguuccaggacagccagggcuacacagagaaacccuaccucgaaaaacaaaacaacgaaaacaaaaaaaaaaagacucuuucucccaugagccaaauaaauagcauuaacugaaaagaauaaguagggcgcuggaauggcagcugggagugacggugcaggccugcgaucccaccuacucgggacacugaggcaggaggauugaaaguucacgggcacgcugggcaguugagugagacccucucuuaaaguaaaaaugaaagagaggacuagagauacaaacauguggugagauguuugaccagcauuugggaaaaccuaugucuacugggggaggggccacaggaaggggagccaaaagagcgaaaaaggacuaagcaaauggcucaggaaguagaaugaauuugaugccccaaacacguguaaagcugggugugguggugcacguuuguaaucccagcccuagagagcuagagacagacagauuccugauacucacuggcuggucagccucagccuagauauugagccccaagccaauaagagagucugucucauaaaaaaccagaccagggcaaagggggcuagagagauggcucaguggucagcauucuugcuguuuguucuuccugccuuuccacacacaugcaccagaacaccacgccccccaauacacaggcguggcuccgcccacccagauaauagacuagaaagugcccaguuuugaacuugaaucuaacuggcuugucaucuuucuuguagaguccuucuccacucccaaguuugaaaucaagcccccugggaugaucauagaaggggaccagcugcacauuaggugcauaguucaagugacacacuugguccaggaguuuacagaaauuaucauccaaaaagacaaggcgauuguagccaccuccaagcaaagcagugaagcugucuacucagucauggccauggucgaguacaguggacacuacaccugcaaaguggaaucaaaccguaucuccaaagccaguagcaucauggucaacauaacagguaggacugcugagggcgggcaggcaauuguggcuagguauaguucuucaugucuguaauggcagcauuuggggguaggggggcugagauaggaggaucaugaguucaaggccagccugggcuaucuagugagacccugaccagugagugugaugccuuuucuguuccagguugucuuggguguaugcaugcugggugcuggggcuugugggaaggauucgaugcauaguagucggcuauacuggcuauacauucguucagaggcuggugcugacucaauccugcugcucacuacuucugugcucuuggcugaacucuugaaccugccccaacugugugagacccaauggggaugugaugguacccaccuuauagcaccaucacaauguccguuuaaaugagguagcuguggucugcauccaagugagcauuggcuaauaucucugcaggugucuguguugucuuuccucugagccaaacucuucuucauggccucuuuacguuuuuuaaauuuuauguguguggaugcuuugccugcauguaggucuauguaccauuuguagacuugguguccaugagggccaaaauaggguauaggcugaccuagaacuggaguuacaguuggaagucaccaggugcugggaauugaaccuggguccucugcaagacuagccagugcucugaagugcugaggccaaaccccagcccaaaucuuuuucuaaaagguuuugggguccaggagucaccccacaaaccacacaaacacugaucucagucagauagggcuguauugaacauauacccuaaaagacugaucaaucagggccauaguucaaauuuugggggcugagucuacgacccucaacauuuuuucuaugucaguuuauaaagacuaagaccacaaaacccaccaaugagcacauacgaagugcuggaaguccugcccaguggucggcccugacucaagccauuuuagacauaacaguucauacugaccuuuaauuugauggguccuaagugacacuuaugguuguggauuuuuuuuaaggucacccaaccucauaacaugcaaaauauaauaggguauguggucagcaaaaccuugcucugaauaauuucugcaccaaugacuggcagguguauuauagcaauagucagcaggaacaaaauggcugcagcuaugcuagggggauagguuucaaaaaaggcauucucucucucucucucccucucucucucucucucccucccucccucccucccucccucccucucucucucucucucucucucucucucuuguugcacacgcccaacuggccaggaagaacgacgcugcuacaggauccuucugcacacguuuauucaguccuguuucuucuuguuuauaucucucuuguuuauauaucucccuuguuuuuauaucuccccuguuuauaucucccuuguuuuuauaucucccuuguuuuuauaucucccuuguuuuuauaucucccccacuaauaguaauccucucucgaauaauaauccuccucuaacccgggccucucacucuuauauacucucaguucccauccacgcacagcaggccacgccacuucaccaggcacgcagcuucagcuaaucagggcaucaggggcaaaucuccaccaaauuggauucaccuguauccugguacaccugcgcagcacucaagauguuugugucuuauaugaggaagucaggugcaagucauaugacuuagcugcagucucuggcgccuuugggacugccgccacacccgcuccccacacucucuuucucuguuuuucaaaacaagguaucucugucuugaaaaaccuguccuggcuguccuggaacucccauuguagaccaggcuggccuuaaacucacagaaaucuaccugccucugucucccaaguacuaggauuaaagauaugcaccaccauagccagccuguaaaagauuuuaacggguaugaugacacacaccuguuccauaugucuauaaugccagcacuugaggggcagaggcagguagaucucucugaguuugaggccagucugaucuacagagugaguuccaggccaaccagagcuacauagugagacccugucucaaaaaacaaaaacaaaaacaaaaaaaaacaaaaagauuuugaaaaaagacuauauguaugucugugugcauuuauauuuacucucugugugugugugugugugugugugugugugagagagagagagagagaggcugagaucagaggaugucagagccuuuggaaguggaguuacagguaguugugagcugguugauguagguacugggaaccuaauccaggccuucugcaagaauaguaaguguggccuggugugguggugcacgcaugcccagcaguugggaggcagaggcaggugaauaucugaguuugaggccagccuggucuacagagugaguuucaggacagccagggcuacacagagaaacucugucuugaaaaacaaacaaacaacaacaacagaaagaauagcaagugcuuuuaacuauugagcuaucucucuaccuuccuccguuuucuuaaagacaagaucucauguggccgaggcuagccuuucacuuacuguguagaggaauuuguccuugaacuccugaccuugcugccuucuugcaaguccuagggcuccaggcgugcuccaccauagcaggaacugcccagugcuaggucuccugaccccaguucucggcuuuaucucucuaaaauacuuacacuuugacuacuguacucuuucuuguuugcugugcugugcauucagcuguuacaauguaagcagcugagggcugagaccuuaacucuucugcucagugcuauguccuuaacuuguacuaugguuagucagaggauugggcugagccuuguguuacaauguuuccaagagcagagucagcacuucucuucuguugaaagucuccauucauaaaaaccguccucaguucauucaguaguuuccccccaaauccccaagugucaagcucugaacaugcggucacagccaccacccccaggcuuauaauagguagguagaaugccaacucaucaacuaggggauuggcacacuauaucagauccuccugguguagggugugacaucaugcacaauuuagugaguuauuuauuuacuuauuuacuuauauuuuuugagacauucucauaauguagcuuagaacuccccuauguagaccaggcuggucccuauauaaaacucaagugcugggaucaaaggcaugccccaucauaccaagcauggauuauugauaaugacaaacauuuggagugcucuugauaaggcauacauucucuuguuagagaaaaaagccaucauucauauauauauauauauauauauaaaacuacauauuauaauacauaugauauauaucauauacauauauaugacacauccuucuguauacugggcugcuuacuaagaauugaggacuucagauacaagcaggccugucaauggggguuucuucuugccauaaugaacuugcaaauuuuaaaaaauauuuacuuauuuauuuuauguauaugaguacacuguagcuguacagaugguugugagccuucaugugguuguuggaaauugaauuuuuuuuuuaggaccucuguuugcuccggucaaccccacccgcucagucccuacuugcucuguccuaaagauuauuguauaguagcugaccagacgcacuagaagagggugucagaucucauaauggaugguugugagccaccaugugguuucugggauuugaacucaggaccuuugauagagcagucaguguucuuacccacugagccaucucggcagcccaugaacuugcaaauauuaucuaauauacuuucucuagguaaccaccuagagcaacuuccuuccaaggacuguucccuuaaccccuccagggugaaguucaguuuccucucugugggcucugcugcaaacaguauuccugaauugagcguuagauauaaauuccuugaagucagccugucucacaugcuguuaucuuuccauuggccagcaaagggucaauacuuguggaagccaugcauagcaguguacacuuguggucccaacaccugggagguagagaugggaggaacagaaguucaaggccaucucuggcuacauaguuaguucaaggucaaccuaggcuacuugagacccucccugucucaauaaaugaguggacagaugagugaauccucauaggaaaugcaggaagagccagcagagagaucucaaggucagagggaguccuguccucacucuuuuguuuguuuguuuguuuguuuguuuguuuuuugagacuggguuuuucuguguagcccuagcuguccuggcuucuuuuaaggccaugcugucaaguauaugagaagcagaggaagacuuuuugcagguuccuaaggguuaauucugcugaaaguaacugggcuacaaaugucugcggcugaggacugaggugguacccagacacguuucaccucccuucccacuugauguucuucagagcuguuucccaagccgaaguuagaguucuccuccagucgucuggaccaaggggaguuguuggaccuguccugcuccgucucgggcacaccuguagccaacuucaccauccagaaggaagagacggucuugucgcaguaucagaauuucagcaagaucgccgaggagagugacagcggggaguacagcuguacugcaggcaucggcaaaguggucaagagaagcggccugguaccgauccaggugugcggugaguacacucucagcugcucagauaugcaaagguuggguagggacuaggagcaugauggucaguuagcugucaccaaugcagucgcaaaggcugaucggauucaggcaggucgagaagaacuccugggagggccaggaaaauggcuuauuggguaauggugcuugcugccuagcccggcaacccgaguucagccccugugauccacguggaggaggcagagaaacaaguccuacaagcucuccuuugaccucuguauuucaucuguauuugugugugcacguagaacgcacagacuucuguguauaucuaagaccugguuacgaggcaugugguacauaccuauaauccugacauccaggacguugagcuagggauuguugugaauucaagaccagccugggauacauagcaagggccugucucgauccuccuugacucccaacauaaaaaaaaacaacaacaacaaaaaaguauuaaaagaagaagauucuaguuggguauugguggugcaugucauuaaucccagcagugaguuugcuggaggauuacugcaaacucacggccaaccugggauacagggcaagguccugcuuaaaaacaaaacaaaacaaaacacacacaaggggucuaaagagauuuuccagugguuauaggcacuugcugcucuuucgaaggaccuaggaucaguucccagcaccacaucaugcauaagccaccaccccuggaugguagaccuacaggcaggcauguaccaccaucccuggaucuuccaccuccugucucccuccauuaucuuccuuuccccacccucccccugacuuccuccuuuugagacaggacaacauuauacuauggagcucaagcuagccucaaauuugcaguuuuaccgccugcccucccagguauggaccuacagguguguuccacuacacccagauauuauaucauuauuuugcuuauaaaaauagauauuuuagcagggcagugguggcgcacgccuuuaaucccagcacuugggaggcagaggcaggcggauuucugaguucgaggccagccuggucuagagugaguuccaggacagccagggcuacacagagaaacccugucucgaaaaaaccaaaaaaaaaaaaaaaaaaaaaaaaaaaagauauuuuaagcagggcuguaauaguauacuccuuuaauccccauacucagauaguagagguagacagaucuuugugaguucaaggccagccuggucuacagaacuaguuccaggacgucuaggguuauacaaagaagccuugucuaaaaaaaaccccaaaccauaaacaacaggaaugauuaauaaaucaaaaacaaaacaaacccaacaaaauuagauuuuauauauauauaaaauuuauauuuauauauauauaaauuuauuuauauauuuauauuuauaaaauauauaaauauauauauauuugcuguucugacacagugucucacuauguagccuggccucaaacucauaaaguucuuccugucuccacuuucuuagugcugggaauugaacucaagacuuuacacaugcuaggcaagugcucuaccacugggcuacauccccaucuaucuacagcaguucauuuucucccuuguauauugcacacacacgcacacacacucaugcacacacacacacacacacacacucaugcacacacacguauagacaagcauugccuggacaggccacagcccuauaggagccccuuaagauggauaaggcaggcaggcagguaggcauuggaaaucaugaucucgauugggaaagccaagcucagaguuuucagaaggaagguucccggcuggguuguuccuuguguuuuauuuggauuuccccuguuguuguagaaaugcucucgaagcccaguauuuuucaugaugccaagucugagaucauaaaaggacaugccauaggcaucagcugccaguccgaaaauggaacugcacccaucacuuaccaccuuaugaaagcaaagagugacuuccagacucucgaggugaccuccaaugacccagcaacauucacagauaagcccaccagagacauggaauaccagugcagagcggauaauugccauucccaccccgcgguguucagcgagauccugagggucagggugauagguaagcagcugucuucugugaagcaaagguagggcucaaggcuagcaaggcuagggacuguggccaucacaaggaugcugccugugcaacccauagcagauauguaucaaagaccaagccccagauggugggucugagcaauauccgggguuucuugauguggccguuguaacccuuuuugaccuuccaagugacaguugacugcugguauuauguaguugggcuuccgugguuugagggggcggggugcuuuucagaugaagagagagcugcccucaagaacugcgggcuuagaacucuuuccuugcuaguggucuuaguggaacaucugugucacacaugaaaccugccacaggccuugcugcagaccaugggcucauggaaauagcugacauuagccugggauucucaccauggucuugggguuggauaucuuuuccucgagcaucugacuugugccuuuggguggcuuguugcagugucgcugcccccacugcuuauaagacucccaaugugccuucuccucuguccuucagcagcuuuuguuuagcagcucugugucgucaacaggcaguuuauaggugcuggagagauggcucugugguuaagaacauuagcuacuguuucagagauccuggguucaauuuucagcauccacgugacagcucacaaauguuccuagagaucugaugcccucacacagacguacaugcaggccauacacuaauguacauaaaaaugcaucauuaacaugcaguuuauaauuguauacuguguaccugugcuggugugggcgagaguuggcuacugguacaggguaagugguccaacaagccuguaauccuggcacuuaguaagcagaggcaggcagaucagguuauccuuaucuacauagugagaucaaggccacccaaggucacauaagacccaagucucagaggacaagggagggagguggggcauaauaagaacuggucugaggaggggcauaauauggacaugguuguuaugcauucaggcuguuguugaagagugaagacuucagaucuccagauguuaauuaauaauaaauucguccaggcggugguggcguacuccuuuaaucccaacacucgggaggcagaugcagguggaucucugaguucgaggccagacuggucuauaaaguaaguuccagggcggccacgacacagagaaaacuugucucaaaaagaccacagaagaagaggaagaggaaacccgaguugaaauugggucagugcuagugacgagcauuuacugagcccuucccaugugcccagcccugggugaagcacugugguaaauuaucccuaguaauauuuaaaauagcacaugagacucauaagugaacucacuaagacuuagagcuaaggcacgauagguaggacugggauuugaacccaggcaguguggcuccugagaccaacucaccacuagccucuuguacuucccggggggagagacugucaggucuagcagugugcucaggcugucugccccugugugggaccacugccaucccaggccugaugcucagcuuccuucaagaucauacgcccuuugugcucagagaggugacaugugucugugugucacuaguagggaagguggccuggaauggugacauaggaccagaauuugaaugguuaggaauguugcugagggaagguggcacagugggggcacaguggauuugccucucugagcuuccaggugggaaggaaaccaugaaguuccgggaagcugucuggacaggaaacuucuguuuagguuucagugcucagaaauaaaagcugaguguggaaguaaagucucuaagugaagauggaggggcuggugagauggcccagccuaaugaccugaguucaauacccuggaccuuacuugguggaaagacagauuccugcaaauuguucucggaguuccacuaacacacccaugcacagaauaaauaaguaaaaaaaauaaguaaaaaacaauguguguguguguguauauauguauauauauauauauguguauauauauauauagauagauagauagauagauagauacacguauauacacacacauauauauacacacacauacguguguguguguguguguguguguguguguguagaguggaguuggaagacuuaggaccaacuuuucagaaaauccaaacccauauuucauugccaaaauaaguagugaagaaggcaggcagauagcaagggaggagaaucugcuucagaggcagcucagauagugaagccaggucaacagggaccgggugauauucaggcuauuggaggccaagacuggaaaaccagguuaagaaugguuaaaacuuccuccacugaauuuucucuuuaggaucauggucuuaggaucaaggaaauuuuccagcaucuuugaaacuagaaauagcaaugcaguuucaaaagcagauggguagcuacagauguugguacauaccuguaaucccaggauuuuggaggcuaacaucuggaguucauggccagcucuaugagaccuggucucaauacaaaacaaacaugguuaugcauaccuuuaaucccagcgcuuaagagguggaggcagacagaucucugugaguucaaggccagccagaguuacguagugaaaccuugucucacaacaggugaaugaacaagggcaauagcaaacaagaauaacaaaaccaggugguuggaaggcgaacuugagggagagcaaaccaaugagagaggaggcuuuaaaagcacacaggaagaggaaaaaaacagggguaaucgccacacacccuuuaaaauucuuauuuauuuaucugaugugcacugguguuuuccaugaaugguuaucuaugugaggguguccgauccucugaaacuggaguugcagacaguugugaacagccaugugguugcugggacuugaaccuuggugggguucucuggaagagcugccggugcuccuaaccacuuaggcaucucuccaguccaugugccacacaucauuguaagcagaaaggcagagaugaacacacacacaaacacacauguacaccuacacacauacacacauacaugugcacauguacucaaaacuccaagacagagcacaaguuaaucuugucauucaguugaguggccagucuugcucaaggugcgaagauggugagugucccuagcaucuuguguuuuaucagugaauggggacaggaggugucuguugcuguccuucuggucuaaucaguggaaguggagagaagaggauugaaauccuaggcuggaagagaagcagauaagaagcaguggccauucuguguucccucucuguucaacucccuucuucucccucuuggguucuuugugacuggaucucugugucguauccuggcuuggaacaugagcuccuucugcaugcaucucccaaguacggggauugcggcugugcaccucuuacuugcuucucuccccucucugcucggggcuaauccuuggccugcuuuccagccccaguggaugaaguugugauuuccauccugucgaguaacgagguacagucuggaagugaaaugguacuucggugcucugugaaagaggggacgagcccaaucacguuucaguuuuacaaagaaaaggaggacagacccuuccaccaagcggucgugaaugacacccaagcguuuuggcacaacaaacaagcuagcaagaagcaggaaggacaguacuacuguacagccuccaacagagccagcaguaugaggaccaguccccgaagcagcacucuugcagucagaggugaguccacacccccaccagagcaucaguguggggggcuuccgagggucagaaagcacgaauuccuuguaaaagggagaggaguggagacuagcucauuugggagagcuaagagaccggugucugauuaguuacaauuagcagaaacccacucauaguagcuugagcagaaaaagagaugauucuauuuauauauaaucugaaaauguuuuauccagucccaauucuaaguauccgauagagagauaccaguugacaguugacgcauacuguggguuaaaugucuauccaugaacgaccuguauccaacauagauguguugauaggauucuagcugugugcuugaaugagagaguccuguagagauggagggccaccccaaauggaacaacaccucuacaaaauuagcuugguaccuccuugaagacuguaguugaccuugguuucuagcagaagccaccauuuccacccaggcugaguacagaagcccucaugggcagacaccaaagcaaaaugccauuuuuaaggaucgcaaaauggggucugaguugcugcuuaaaucugcugccauuucuugcuggugggaggaaaacauguguuuccuuucuuucuacccgacuuccagucuuccuugccccauggaagaaagggcucauugcggugguugucauuggaguggucaucgccaccuuaauaguugcagccaaaugcuacuuccugaggaaagccaagggugagugccugucugcagccuggguuuccagggaacugcauccuggaggaggcuaagggagcaccaugcauucuccuuaugggaugucggcuugguaacgcaagggccuggcguuggugggugugaagcuuuggcggcucacuagcaacggugcuuguggaguugggcaagccaacuggggggaugugggugacauuauaccugaucuagucacaagaagcuauuucuuaguguguguccccaaguguggugguauagggcacauacaggcaugcacauucuguguguggcacaugcacaaaugcacacacugugugccucccagauauucuucuaguugugucaugaucuuguaucauguaccauacacacuugugggaauagggucuagccuaggcuuaaguaaaauggugcugcugucugagccgggaggagcagauggguuggggucuuuugucuuuuccaagguaggaaaaauugugcugagcuacacccccaguuucucuuuucuccuuuauugaguauccgggcuuuaggagaaucaauggaaagauggucacuguccuguauacuuacacugaccuaaguuuuucuuucuuuuuuaaagccaaacagaaacccguggagauguccaggucggugucccuguuaagagggggguggcuucuuugugggcagggcuggauuugucugcaagcccagacugguugcuaggaaguuaucagagauucuuagcaaacuaauaaagaauaagggccuuggguauaauggguguguguguuucugucugucugucucaguggaagauugccaacucauuacauacuuagaauaauagaguugaccuuuuuaaaagaaauguuuuuuaccaagcuggagagauggcucaaucucugcugguaccaugcacuauaaaugugcaugcgugcgcacacacgcacacaccucuaaaauuuaaaaaaaaaaaaagucuuugcauccuuuugccaaggcuagccuuaaauucaugauccucuugccuuuaccucccaagggcuggauuacccaagggcaugugguaccacgacuagcuuuuugugucuugcuguguagcccuggcuagucucagagucacagccauucuccugccucaaccuccccagagcugugauuacaaguguacaauugucauauuucuucuugcuuucucguggucuuucuuugaugguuuuguugguuugggggaagaauaucaauacauaauuuucucuuuucuucuucauuuacaugugaaggccagcugcuccacuucugaacuccaacagcgagaagauuucugagccuaguguggaagccaacagccauuacgguaaauccaagucuuccuuuaauuacaaaaguuuuucccaacucaauguauaagguaggauuggaguagaagggaaaccccagcuucaggcagugguaccguuaccguauauaacaaaccaugagaagauuagugauacacagcaaacagaaaggaaaggcaggaccuuuucugcuuuccccaucucugcuucauuucuuugggaugaaaaauggagacugacccuacugcuuguugccuccauagacugaaauaauuaggcaguacaugggagacagaaaccagauuuuuuuuuuuuuuuuuuuuuuuugagacaguguuuuucuguguagcccuggcuguccuggaacucacucgguagaccaggcugaccucgaacucacagagauccgccucccucugccucccaagugcugggauuaaaggcgugugccaccacugccuggcuugagaagucacucuggugcaggccucagaggagagaggcugcccagugagucucaggacccuugggucugugagaaagucacucagaggcaggugugguggcucacucugaacaucucagcacucuguagggaggaaggagcagaugcagauggacauauuggaguccaucuuggucuacauagugaguuccaagcccaguuggggcuccauaucaaaaccuugucucaaaacaagcaauaaaaacaaacaaguaauuugaauaauagcacugauuagcacaaacacacuuuggaaaaccauguguuccugaagaauaguauaauaccuuauauauaagaauauccuaaggaaaacaacaugcuaagauguuuguuuguuuguuugcuugcuuuauagugcuugggauugagccaaagccuucacacauucugggcaagggcauuaccaccaagcaagccucacacuucauuuuguguaugugcacuggugugauaauccagagacacuguuauuucuuuaagucguauucucaucaacuuacuucccuaaccagacaauguuagcuaaccaucagcuuucauauuuauuuuuagucacuggcccuuucuagaaaggagcuucauuuuuaauuaguucuuacaucaaaccauucugaauuccaaauaacucucaaacgaaagugccccucugcagccauacuuucuauccaggcaguggagggagggcccacugcaugcaggaaaagcucacaccgcagagacaaaggaggagacccagggccagaggcgaaggugcuugucaccuggagaggucagacuugacuuucuuagcaguacuggagguuuuagaaguacuggggagauggugaaguguuugcuguugcuguguggaugugaggccuuggguuugguucccuagcaccuauauauaagccacaugugacagcaagcaccuguaaccccaguacaggggagguggauggaagugaccacaccccaugggcuccaucaugagcuaguccugcugaaucagcaagcuccagguucacagagacgcugccucaaaaaauaaggcggagggagagugauagagcuuccucuaucaugugaugucacacgagcacacgcacacuugugcacacacacauaugcaugggggagagcacacacucacacacaugcacucacacucacaucaauggguaagggcacacacacauacaugagugagaacgaacacacacacacacacacacacacacacacacacacacacacacacaguuacgguuacaggaaacugauaucuauugucacucauccugacuguuaauuuuucaaccagguuaugaugauguuucuggaaaugaugcaguaaaacccauaaaucaaaauaaagguaauuauuuaaaaauuguaguagaaacuuuuacauuaaaaaaaaaaaaaucacgggcagcuagcugugugcugugugcuuuaaucccagcacuccgaggagagaggcaggcgggucucuggaaucaaagccagccuggcggacauagagaguucuagagcuacacaguaauuaguaagacucugucuuuaaaaauaaacaaauaaauaaauaaucacagagaaaaggaaacguaaacucugagcugucuggauaauuuccacccgucuuagaggcucugucuauaugagccuaaugguaaaguguagguggccggguuuuuuucuccaaagauguuagccaguguucugaauggugaugccuccuaaccuaaguagaagcaagcugucauaccuaaaaacaacaacaacaacaacaacaacaaaaacaaaacaaaaaacaaagaaagaaacaaaaaaccuuucuggcucuccaagugcuguaggaagguguuucucuuggguggcugagguggagaguuuaaagaaauuuuuuaaagacaacuaacaauagacaguuuacuucugccuaaggcuuguuggcuuaaaucgccucuucaagauauuuucuauucugugccgcucucuugagaacugaaacucccaaccugcuccgugaagucucuuuggcuacaccaucuguuuuagcugccagcagaacaaaacaaaacaacaaccaaaaaaaaaccucuaauucugugggucuuaaaacagcgcagguuuuacguagucacaucuguaaucacagcacucaggaggcugaggcaggaagacaagguauucaaggcuagccuugacuguguagcaaguccgggcugcccuggaauucauguggcccugucugaagaaacaguaauaagggcuggagagauagcucgcuguuaaacacuggcugcucugucagagaacccagcuuccguucccguacagugaauggcucacaaucaccuguaaggcuagucccugaggaucugacacccucuccuggucuccugggguacuagacacaacgaacagcagcagcaauagccagaguugaaagcaaaaauaauuuccugggugccuccccagagccuggagauuuuguuacccagaaugccucauuuucuuuaaacacuuagagacugguaagcuugguccuacagcauucaaauccauuuccauggccuugagacuggacaggccuugacugcuggagcccaucuugggcugcuguccacaccuauugaaaauccucccacacucuacaagucagagaggcuauguacagugucugcugcccgaaccaauguagggcugaccggaauaaagguuucuagugugguuugaugccuccagaggaggugcuaucuaaacucacagcgcugugauucuuuuaacagacccccagaacauggauguagaauacacagaaguggaaguguccucccuugagccucaccaagguaagcagcccucgccaagugagccgagcccacauuaggcucugggcuuagauguagauaccacaugagaugcuguguacagucagaauugucucuuggaauggacauggucuucuguagaccuacuaggugugccuaagucuggagcuauaaaacugugauuguacucugcuuacucacugcgggccaggcagggacuaagagcugagcacucuucucuggaagagucuaugggagacuauaguuuccuaucccccgccaaguguucaggcuuucuuucagaggccagccccugcucagaugcaccuagaaaaguugucuguguggaccaaacgugugucaaucaaaugcaugcauaaaauggagaauauggggcuggagagauggcuccauggcuaagagcacagacuguuuguucucccagagaaacugaguuugguucccagcaucuguaucggguggcucacgaccaccuguaacuccagcuccaggggaauccagcguccucuucugguaucugcagacauggcacucacauuugcacagagccccuaccaccgcuaccacacacaacagauggugaugauggugguaguggugguaguggugguagugguggugauggugaugaugaggguguggacgauguauauguuacuuuguugcugugacuaaaugccugacaagaccaauuuaagggaggagagguuuguuugcuuugcuauuggaagcaauacaguucuucacagcacagaaaguaugauaacucagacagguuuuuagauacuguguccagggaaagcaaugaauucugggucucagcuacaucuguccucuuuaugcaacuugggaccacagcccaugacaagugucaaccacauuuaggauggcucuuuucaccuccauuagcccaauuuagaccauacacagagagagggggggggcaccacgcgugcaauucuaaauccagucaaauuggagauuacccaucacagaggccuuuccuccuuagggggacguuuggggaaauagaguccuuuccgugugacaugagaucugugccuuagcuuuuuuuguuaggugugugugguucacucaagggcaagcugcccauaaguccauaucugauucagugcugggagacagacgcacaguagguggguuacagcagaucucagccguucugagcaccagaaacaauacccaucucccaacccuucuccaucuuggcccacccuugggcugcugugugcuucaaaggaagcagccaucccaagccuuccggcccuugggaagcucccuaggacugcugccaucugucugccuuugcguugugcuggguucucagccaagcaacccugggcaguuuuccaggcugggccugccaaucauuagcuggagccacuuggugaugguguccugaagccaccucuugcucgaugauuuaggaccaguucuggaguuucucuuccaucucuuacuuaccgagcgugguuccaagugcccugucagcaguuauagaugugaaacuuuccaaucaguagacauguccugugcaacaccacugacacaucccugugaucuccggucagagcugccuccagagguguggacuggagacuuuaaugugcuuugcuguaugggcaugggugguguccugacuggaccugagggguggggcacguggaaggccugaugcucuugucuuuuuuuuuuuuuuuuuuauuuuggagugaaguguuugacucauuuugguagcugauagugacagugacauaaagaugccagccacugugugagacacaaaggcaaggguguucccucccuggugugcguguagucuaagugggagcugggaaaacuaaagaauagaugguaucaggugauuuuaagugcuguggauggguagagugggcugcaguaaggggaugcuuucucucaccuucgcugagccaugcaagagggccuccuugagagccguuaauuaagcaggggcugaagguuguaagcaaggcagcugcaaggaagacaguugauuaaggguggggcugguuagaaagacacagggaauggaaaggguaguuuuggcaggucacagcuagcuagcucauuuaguuuggucugaaaggguugcuggguguguggugcguacccacacucaaucccaaagcauggcugugugacacaggaggaccaagaguucaaggccauccugagauacaugagacccugucucaaaagcaucagaaaggaggcucaugugucugcagagacagaaaggauggaguuaggaggacagggugaugcuggagcacauggggccccaaggauuucaguccuauucuaaacggauaagggaacauaagggaacauuucuggaggcuucaggcugggcaauggcugguucugagcuccuucuuuaaaaaaaaauucuuagggacucuggaggaguucaguggauagauagggaggccuuaucuugucaguguaaggacuggagugugggucucaagaacccacauaaauacugagugagugugauggcccuccuguaauuccaguauuccucaaaaaacagacaggggcuucccagggcaagcuggcuagcuagaccagccauguccacauucagccuccaugaauauggugaagaacuguuguuuguauugauacuagauuuuuuuuuccauacacuauauucaguuuuguuuuguuuuggagacaggguuucucuguauagcccuggcuguccuggaauucacucuguagaccaggcuggccuggaacucagaaaucugccugccucugccucccgaguacugggauuaaaggcgugugccaccaccacccggccauucucucucucucucucucucucucucucucucucucucuuacucucucucucucucucucucauuagaaaaaaaacaggcauccguaaaaaaugagguaaaacacaauacaauaaugaacaaaccagaauagaggaaaucaaagaaaagcuaaggaauacacacacacacagacacacaaccacacacacauacacgcaaucacacacacaugcauacaugcacacacagaagucccauagagucacaaaucuggggaacuauugagaaagauucccagucuuucucagaccuccauacauguuaguccucccaagacauacaaccacugcacacauaccauacauacauacauacauacauacauacauacauacauacauauauacauacaaaagcaaacucaggaccaucaaggaaguggccugaagaagaacaagacagaugugcuaucacugugcaagagauagugggugccagaaauggauggugucuaggugcacaucugagauccaucacagcucguggccaggauuggggagccagagucccuauauuucuugcuggaguagcugcauggacggcugugguguuugaggauaagauccgguuugacuggguuaagucuaagaugccggugagacacccuagaguaggaagcucaggggucuggagcucagaggcaagccaggacagaugaaacuguagagugaucaguaucagcugucacugguccagccugggcuucgacugcauccugggcuugccaacccagguaacaucuuucuucuuccuagagguaagggaaggugcuagcuuaaggguugaauggcaagaucagagccggcuacaccauccuuucuguucuggacugcugcauucuaccguggugggggaacacugacagcuccaggcacaggggaccaaaucccugcucucuugucuguacagaacauccucaaguugccugucaccccgggcucggauaccaggcugaauccauccucccacagugguccaggcccaggucugggcaggcagcagccugaggguugugcaugauacuugugugggagcgcgugccugugcgcugggaguuccgaaagcugaagagggaagaaggaagcaucacuggcccugggaaaggcuccauuucccuuuuguugggagaguguccuuguaucugguguucuuuugcuuucuugagaguguggaaggauugaauagaggaaguguggcaguuccuagaauagggugggaccguggcaauugccucuggcuucccucgauagauucugcagccgucccuugcagccaagcuaucaguuacauuucccagcuugcacuaguugcccagucagggcucuggggaagauucuagaacaaaggucguuuggguggcaaggggaacuuaagaggauacaaauuguguuuccuccuuguugaagaaggacagugaggaacucaggucuggaccacuggugcuggccccuuguucucccccaagcagggacaagggcauugauugcuaggugaagaaagaagggcuuuguggguucaaggucaaugaugacuaaauaugagcuagugccugccagccugguccccuguucucaaggucucucauccuacacaauuggaggaggcuauggggaccggguccagaucuaacccuggcuggcagcucaccaaguggucacugcggauggaggaggacgggaaggaacucauuaaaucccgauuugcugucuguuugcuccgaggcuaauugcugggaaaaccccaugacguuggagccgucucuuucucuguuagcacagagaaaaacagaaaccaaaauagagacccaucaggaaacgccucugacaagcagagacaaacagcuccuggccugggcuagucuuuagcaggcagcugcugccaaggagacaugagagggggaagggcagugagcagcugcacccugcuccuccccuacccccgcccccacccccucuuacugagcugggcaaaaccaggggcaagcauagaccaugcagcucagucuagaaguggaaagcaucccuuccugacuugagguaggcacagccugaagccgcugagguccagagaauaucaaacuguugccaaggagaccagagagguaccuggaacaguggaguucacaagauguccaggcuaaccccacccauguuuggcugcccagcccacccagcccucaccucacccucaucccaauucaugucccuucuauccuagcuccuuguuaggcuagggcagaggaaggucuagacuugcuucuuauggacgacaucuuauagcaguuaucacgcaguuauuuuuagcuguguguguguguguguguguguguguguguguuguguguuaggauacaccugucucugaguacaugcagaagucauggacucuaauuuaugucaggugucuaauuuaugcucagucucccacuaccuuauucuuuugagacagucuccugcugauccuggaucuaggcuggcagccagccaacccuagcagucagcccucuuaccucugccccuaacaauugcugggguuauaggugccuacagcuaugccccagauugucugggauuuggguucaggauuccagcucagguucuuacguuugugcagcaagugcucuuacccacugagccaucucccagcccugugguauuuguuuguuuauuuguuugcuugcacuggggcuugaacccagagccuugcacaugcugagcugguacuguaucacugaaccacaucuucagcucauuaacauucuuggcacaucugucuucccugaagccuagagcaccugaaagcuagaaccggaucuacauuuucuucuuuagugguugaggucacauaggagauguguacagucguuaaauggaucucuugguguguagaaggcgucuuggagacgccuggaguuucagucucugcuugcaugggauccuguuguuucucaauaguucucuuaggcagaugucuuuacacuggggaacugggaucucagcuacuuuacugaccuccaacuccugccuugggaagugacuuuaauuccuucugcaacgccuucaucauucugggugccccaaguucugcugugaugauguggaccacuccuggccuuucucugucauacaggauuuauacagccacccacauccagugucuaaugagaaaccuagacuuuagucccacagccuaccuaccaguccuguggcgugcuccuuauuacauagacaggaaaucucaggaaggggcuaacugugccucgaccuucugaaguucaaggucggcaaugcuucagggccugggcugaugcuuuuccuucauuaccuugcagacaaugcuagggauagccaagacugacuggaagacuaugcaaagccugacugguggggugggguggagccuaagcugggccuuugcucuauaagaccuugggaauccaccagggcagacaacugugggaacaaagaaagcaagcaugcuuuggguaaaugucaccaaacugcucuggggucacaagagcccauggaacagcucagggcacagaagaugcaaauauuggggguauauaugcauauggcuguuggggugaugcugcaagagaaggaaccgcgucagaaauggaagggcucagaggccagagaaaggaagaggucacuguaggaguggccucacagcaaagugagaaaguaucuuugguguaguuagaauccauguggggccccaggcaucugcaauaaggacagcauguggcaggacaucucaggcucucugagggagauaggcagaggagggggcuagcccaaacccauccagcugugcaaggagacuuccuggucuucccugcaaguaucagaaaccuaggauguguuccgguuuuguccugcuuccucggugucucuagauauacguaugucuguauauacaugagugcauucucugugugagucuggauacuguguacaaguauguauagugugugcauacucugugaguguacacaacaccuguauauacacauccuugaacauauuucaauaugaaauaaacagguagccuugucuucuauucugaaggucuaagccagagaauuaugacacuggcuauagguucaagaccaugcagaguacacccguguaccuaggcguaauggugcaggucuauaaucccaggacuugggagaugaaggcuggaggaucaggaguucaagaccagccuaggcuauccagcaaauucaaggccagucugggcuacaugaaacuguuuuaagcaacaauaacaauacaaacaaaaaaaccccaacacagaacaaacucaugccaggccaggccccagcgugcuucacuuagauucuguagugagccuagauguugacaccagaggcaggcagcucagcaagcucuaucuguaaguggcuguuguccugucuguauggcugcugcucaugccagacuccaacccagaccucaggauccaauucuaauucuugggauccacccccccccccaacucccaguggcugugaggcuguacauagcagagcccugauaggcagguccugguagggcagcugacacagggucuccguggcagggaaaggggggugggugacugggcuagggacuuugggucugugcagagucuucgugcagccgggcucuucacacaguggccuacugaccuacuuucagugucuaggagccucugguuaggucugaacuucugaagcuggggaaugaugauauacucgguguggggcuucucgacggggcagcguugggugucgggaagguacagcagugggcuagccuggggcuccaaggcagcuacugaccugugccugguucccuuuccagcucugggaacgagagccacagagacgguguacagugagauccggaaggucgacccuagugagugaggggccccugauucccagagugggagggucugugcuagaaucaguaauggggccuugagagugggcagaggggugggggaaagccaaaaagagcaucaacucuuuaucaccgucccccaaaacccucuuuugguuuuuuugagacagaguuucucuguguaggccuggcugucccagaacucacucuguggaccagucuggccucaaacucagaaauccaccugguucugccucccaagugcugggauuaaaggugugggacaucacuucccagcagagcaucaacucuuauauuagggucugacucugucccuccuaccacccuaagaauacagaggcacagacagucuaagaucaagaucacagaagcacaucucugagcacccagagcuagacuccacauucccaucacugagcugcagucuuugguuagagggaaggagcuggcaggacgauuuuuccucuuacuggccuggguuccugccugaggccuugcaaaugagacaguccagcaaggaauaaguagacuggguugauuaaccuguagaagaaaucucagagaggagugacucagaaagaagguugggggaggggagguauguaacugcuuaacaauaaacguguacagaaaggacaggaugcugagccuggugguacaggccuguaauccaagcacagggcagggacaacuggaaaagcaagcguuggucgcccuugccuguauauaaaguucaagaauagccuggcuauguacaugagaacuguauuuaaaagauggggagggggccgggcgugguggcacacgccuuuaaucccagcacuugggaggcagaggcaggugaauuucugaguucgaggucagccuggucuacagagugaguuccaggacagccaggacuacacaaagaaacccugucucaggggaaaaaaaaaagauggggagggagggagagagaaagagaagaaagaacgaggggcuggauagagacugcucagcgguuaagaacacagcgguuaagaugcucuugcagagaggaugggauucaguugcuagcuccuacaugguagcuugcagccauuuuuaacuucaguuccaggggaucugacacccucucuggccuccagaggcacuagaaaugcauauaguacacauauauacaugcagacaaagcauccauacuaucuggggcagacuguccuuacacuccucauggucuucacugcucaucugucuugauuuggguuccugucaucaccagauccauuggagaauccaauucuacguuaaaccggcaucuuugugugaugggguggcccuggguggccuuggucaaaccaugaaacauucccagacuucuuuaacugucaccuucucugugaaaugaggggauggacuagauuccugguuagauugcccgauccacucccagcccugagugucugaauccuuuagguugaagaauuuauauuucuaaccacucauacaauauuggcugaggaagcuggccuggggacuccaguuugagggucagucugugagugcugugauugugccacacagguccugccccuagggucucucucacuccccccccccccccccgcgcgcgcauccuguacugaucagaacagagacagcugagagagaaaauccagaaauacccugugugugcacagagggugacagaaggugcgcguuugcagcuggcggcugacuggguguagggaaggcucuuagcagccgcuccccucacagucuuugcuauaucuucaguggcaccccaggacaggcuguuuggggaaauggcucauagggcggaguuuuggcucugaaacccccuuuccccugagagauucaaaggaaggccacuccccuagauaagcagaagggcuuaggcaggacagccuccaaggagcagguuccccuccccacccccaccccaccccccagggaaugggcccuuggagagauuugggggagcuugacaaagaagcaggagggagcuugcaagccaugagaggggcaugcugucugcaaucucggcuuuagaugcuaagcugaccuucuuuuucuguauuguuauaacauguacauaaaacuuaauguuuuaaccauuuccgaauagucagguggcaaaugugguguccuuuacauccuuugauacuguuggguagccagaguucucaccacccauuucccgaaucuccaucuucccagucccuuaaccaauaacuccauccccaccugcugccugccccagccguugguccucaccauucugugaauuuggccccaccacacccugucugugaauuuagccacgcucagccuuuucucaugucaaacgaagagacugagccagcggguuugagcucucuuuuaauugaaacacuucaagagucccaggguugcacuggcaagaaggucagcaagcaggucaaggcauuaucaccaagccugacagccugaguucaaacccugugacucacauaguggaaggaggggcugaaccccgaaaguugcccucugaccuccagaugagcauggcagcacaugcaccucaccacccagauuaaguaaauaacuggaauaaaaauaaauaaaugugcaccuggcagugguggcauauaccugugauaccaguguuccugaggcagaggcacgcagaacucuggguuugagaccagccuggaauauagacagccauagcuacacagagaaauccagccuugaaaaaaacaaaacaaaaagagauaaaaauguuuaaaagauuaaauaagacaggcaugguagagcucaccucuaauuccaguacacaggagguggaucuuuguggguucaagucuagcugggucuauaaaaacauuucagaccagucagagcaacuaagccaaaccaguuaauuaauuauuaauuaauuaauuaauuaauaaucguuucagguuccuggcauuuggaaauagagagcagccccucagccuuggccccucuagcucugucugccuggacacaccugggguguagucacuuuaaggguuaacccgagucuaauccucaacucacccucaucucucugucgacacucagauucuauagauguuuucagaacuuccuagaucucagggucugccugucuucauuucuccggaguucgcacuggccaggauccagccuggacauuuuucugugccauugucauggaaagcuccauagcugggcccccugauguuggcucuggucucguccgacagauggacagagugacccuggcacaggaacgacuauaaaaguaggcagaaauacacuacagugaaucuugggaggguaagggcugugauggguuuuguaacucaaacauucagagccccccucagggucugcuaagucucucugcagcccacuaacaccagcuugcccuagcaaugggcucuuagguaagaaccucuuaggcagaggcaggcggaucccugaguucaaggcuaggcugguuuacagagggaguuccagggcaaccagggcuacccggagaaacccugucucggagaaauacaaacaaccacaaauaacaaaacaaaaagaacaccucuagaccuuugaacguuguccuuuccuguugcugcgugaggcgcuaaugccagccuguccccuggcugagugugagcggugaggggagggcaggcauucucagaacuaacaaaguagagauaaacaaacucuaugccugugaugcuagcgcuuucgcgcuuucgaggaggaaacuaugcuuuccaagauggggaguucaaggccauccucggguaaauagaaaguccaacuccaacccaggccucuugagacccuauucaaaugagagagagaaugagagagagagagcaagagaggagccaaaucuagagaggccaaagggaaggaaagaauaugcguugguuguaaucagaacaaguaagaggccguucuucagcaguaaucuguggguuuuguuuuuuauguuauugguuuaaucuucaguuuccguggaggaaugaggccaaugcuguugauggucaccaccacccaccccaugauugacugauugauugauugauauuggggauggaagccaguccuccugaguaucugcccuugagucacauuucugggucuuuccuugucgcuuagaugcaaacuuaaucuuucagcauucuaaaaguuauuuucccuuuuaguuaaaaaauauuagccgggcuauggugcauaccccuuuaaucccagcacucaggaggcagagguagucggaucucugugaguucgaggacagagcgaguucuaggacugccagggcugcacaaagaaacgcugacuuagccgagcgugguguugcacgccuuuaaucccagcacuugggaggcagaggcaggcggacuucuaaauucgaggccagccuggucuacaaagugaguucuaggacagccagagcuacacagagaaacccugucucaaaaaaaaaaaaaaaaaaagaaaagaaaagaaaagaaaagaaaagaaaaagaaaaagaaaagaaacucugacuugaaaaagaaaaacaaaaaccuucauguauguaccguuggugccugguaccacaaaggcuggaagacagagucagauacucugggacuggaauuacggguguuuaguugugaguagccacaagggugcggagacucgaaccuggguccucugcagaagcagucaguguccuuauccacugagccaccucucuaagccuuuacgucuucuuuuauauuacuuuccugagguuagaauucacaagccucagucaguggcucuaguuccaguuuaugaaugaaucaccuuaaccagaagagggaaccguuaagugugugucucucagggcacagcggugaacuguaagagagaguaggccaggccgaggcuguauacauuucugucugucacuuaacucuggacuccauugaccucagacuucaugcgggauaaucugugauaugccugagcucuaggggguuucguuucauggugguggccugcagugcuggagagucggcccgcaggaccucaggccugccaguuagaugucuguccacugagucacacccccagcucagcacacaugcacgguugcuacaaccugguguagggagagcaguccugaugagucuggugaguaggagucagggaugcuaugaaacaucucgugguacagucagucucggucaagaguucccagcccagaaugucagcaggaugaacacagagaagcccuggcuuagaggacaccagcuucuaugccuguccaccaggagagcucccucagacaccagcucuugcuuucucuguguccaccucaggagcugaccagggcaccuggucccacccacaccucuggccuguaaaggaaaccaagucuugcucucagccccagcucuguaucaguugggcacccccacuccccacccaagcgucagcuacuccaccccucuucacccuugcuuucucuuuguguggaauucagacuuccaggaucuuuuccuuucaucuucuuuuccaguuccucccuaccccaucuccuuuucuuuccuuuucuuuaagacaguucaguuaaccuccaauucauaaccuuccuguggcagccucucaaauggugucauuacaguugugcaccaccagacccagcucaggaugugugaauggggcugggggcggugggaagcgagugggcagaaaucccucaucuuucucacauuccuuacugccccuuaccaagaggauagccaugacaggaaguaccaucaagaaagaaccugaccuggacaucauggcacuugaaaggcugaggcaggaggauugcugcaaaucugaggcuagacugggccaggauuagacccuacaucaauuuaaauuaaggagaagaggccucucagcaggaagccaccaugucuaaggguggaacacucucuggucucugagcccugggcuucaucuugcccucccucccccuguacccccuccccccauuccuagaacucugagcaauaaauuucuguuguuucuacauuuaaaaaggaaaaaauaggagcaggggugggggugggggugggguccuggcuaaguccucugaagggagagaagaacacuugaaaguugguucccacccauccuguguggcccaaagccagcugggccagcagguacugccaggguggcacuuccugccugaacacgcaggaggggaaaguaccuuacgccgugccccaucguguaacauuacccaccaaagaaacagucuccaagugggcccagacuugccugccaucagucuugccuucucccaugcagaguuuuguuuuuugguuugugagguuuguuuuuuuuuuuuuuauauuuauuuacuuauuuauuauauguaaauacacuguagcugucuucagacauuccagaagagggcaucagauuucguuacggaugguugugagccaccaugugguugcugggauuugaacucgggaccuuuggaagagcagucggcgcucuuaacugcugagccaucucaccagcuccugugugguuuuuuguuguuguuguuguuguuuuuguuuuuuguuuguuuguuuguuuuuccgagacaggguuucucuguguagcccuggcuguccuggaacucacuuuguagaccaggcuggccucuaacucagaaauccaccugccucugccucugccuccccaaugcugagauuaaagguguucaugcgccaccaugccuggcugccaugcagaguuuuaacacgucacauuuuguuucugcuucuggagaacgugggcugggugggggaggccgggacaugggguucuucuccccuguggagaccugggccaggaggagcugucauggccucccucgguguguggaggcugacagaguggcugcucggugccugggcugauguacagauuuuuugagaggccaacugccuuugucccgcuagaauagaagaggggccccuuugggacagcgguuccuguucccucuaacuaggaacaauggaauauuauaugacaggguuugaaggggaaguagacuuggggaaagcagguuuuuauuuguuuguuguuuugugacagagccuggaacucuugguaaucccccugccuggcagcuugacugcuggauuuacaaagagagcuaccacacaaggcucaaaggguuuuuuguuuguuuguuucuuaggauuuuuugguuuugccuucuaucuuuccaccucuucuuccucugugucucugccugucugucugucugucucucucucucugaggaugaccuugaacuccugauccuccugccuccaccucccuaacaccagacuuuauaagccccgugcugccacaccaauuucuaugauacugggggucagccccagggcuccauguguuccaggcaagcacuuaaccagcuggccugcacccuuguucuuggcuuucucgccaugaccuuuaccaucuguaagagcagccaccaaccccuaacccccuacccuguccccaccccuacccugcccccagcacaugggaacuuuuuucccagagagcacaugagguauucauugcugcuguuuccaccagaccuggagaaucagccccaacacagagucagucccugggaugggcgggagagucugacucugugcgaagaggcaaauccuaccccagccucccaucugguggugaggcuccucuuccagugaugcaggcagugaugugauccuuccgugcagagcuuccugcucucucacucucuccacuuccaggcuuuugucagaggccaugggcauaacaacgguggccuggcugggcagccgggcacagugugcauucugacaaaaggaugcgucaacuugagccucauaugggaaagggaaauugcaggcucugcucuuagucaguuuggccauggaugccaagagccugaguuauccuccuccuccucuucuucuuccucuuccuccucuucuuccucuucuuucuccuccuccacuucuucuuucuccuccuccucuuccuccuccaccucuucuuucucauccuccucuuccuccuccucuuccucuuccuccucuuccuacucuucuuccuccucuucuucuuucuccucuuccucuuccaccuccuccccuuccauccuuacucccaggaaugggcagacaguguaaaaucaacugugagaauagauuugcugccaaagauauuggcaacauuauuuacuuaagacagcaaaauccuggacagaaccucuuuuguuuuuaaguuuuguuuauguguauggggguucugacugugugcgagucuguguagcaugugugugccuggugccugaggaagccagcagaaggugucagaugcccuaagacuaaaauuauagacaguugugaaccaccauguagguacuggaaaucgaaucugggaccucuggaaggguagccaguguccuuaaccacuaagcgaucucuccagccccagaaccuagcuuuuuaaaguuaggaaccugguuaagcaaucagcuguguagccacuuaacuugacgguguagcuacuuggacaguggcauuuaagaaaggucaugagccaggugugguagcgcacgccuuuaaucccagcacuugggaggcagaggcagguggauuucugaguucgaggccagcauggucuacagagugaguuccaggacagccagggcuacacagagaaacccugucucgaaaaacccaaaaaaaaaaaaaaaaaaaaaaaaaaaaaaaaaaaaaaaaaaagaaaagaaaacaaaaggaaagaaaaagaaagguuaugaaaguucuuacaaaaccacacugcaugaaaggaugggguggaacacaucacaggccuaucgcccuaacuuccccugacccuccccaacaguccacucagaacacugcuaggggacaguggaagggaccaaaaguggguggaggguggagcagagaucacuuuuauuugcaacuuucuaauuuucuguuuucuauuuuucucuacuaauuaaaaaucuuuaaaaugccacacaagaagcugcacuucuucgaucccggcacucuggaagcagaggcagguggauuucugggaguuugaggauaccuuggauaguuuugaacagauagcucaaggacacccagggcuacauaaagagcuccugucuuuaagaaaagaaaagccacaguggggguguaguugguagaaugcuugccuagcaugcacugggcccuggacuucauucuuagcaccccaugaacuguguggugguucaugccuauaauugggaaauggaagucucagaaacucaagguuauccuggacuacauaguaaguuaaagggcuagccuggccuacaugaagcccuacuuaaaaaaaaaacaaaacaaaaaacaaaaaucaaagcuagcacacaaaaaggucaaaugacguuccagggacucuacaugccuaucucauggcugagaagaucccaggggcuugccuagagacaaaaggccaucaguagauggccugagacccccuuauacacuaguguucugucccguccccaacccuccucuauauccccccuuugccauuugccacuuugcacauuuccagcagcagauccagugugaagcugcccuaccucgcacgcucaccuuugugccgucuuuguuuugcagaucucauggaaaacagauacucuguaaguacacacgucacacacacuacguuaaaaaugcacccaugaagcuugguaguagcucauaccugaaucaccacacugaggaguguuguggacguuugaggccuuccuuggcuacagaauucccuuucaggacugcaguauguggcuguugcuguugcuuuacaaagguguucuauagaacaacgaacuauuucccaauuuguccagggucugcuuucuacuaauucucgccagcaccuuguucuaaccuggcccauuugagaccaggaaccguggcauccucuggcagucuaagccaguuccaguacugauucuccugucuauaccguuacagcucagucuauauagggagagggaccaugggaauccucccaugucgcugggagucuuucugcucuuuuaguaagaaagagucucgggcauagugagcgacacacacuugagagaggagcuugugugcaagaccaguuuggacugcauacuaagucccuggugagagagggaaggggagaggaaaaggaaggaggaaggggaagagaagagagaugaagagaggaaggguagggagauagggcaguuggccacauacuuacacaaggaucuggguuuaauccuagaacccaaagugaaaauuucaguuguaguggcaaacaugugagaucccaguccuggggagaugaggacaggucccuggggcuugccaaccugcauggugagccuaaggccaacgagagacccuguugaaagaagggaaggaggaaaggaaaggaaaggaaaggaaaggaaaggaaaggaaaggaaaggaaaggaaaggaaaggaaaggaaaagaaaaagaugaaugguucuuaaggaaugacgucugagauugccaucuggccucuauaugcacguagacacacucacaaaggaacauuuguacacaggcaugugcacgcacgcacgcacgcgcgcgcgcacacacacacacacucacacacacaaaaggauguacaauaaacucaggagggagggagggagggagggaagggguuuaaguucaacccauucauaacccacugccuuccgguucccagccugucugugggcacccagcagcacagggguuaacagggcagcuauuaucuucaaaaauaaggaacuggccucugaacuggucuuuugggucugggagaaacuuccagcaagacuucucuguagccuucaguggggcccuggcuuccuuuguuuugcugggucugaauucuugcuaaacagagcucauuaugcucuggacagacaggaaggcgcugacauucucuguggggaugaaggcugucuguuuaaggcgaagaggaaugaggugaacagcuucccuagcugcacccacccaggcugcugagagcacuguuguguggaaggggcaagggagccuguuucauagacgaagaaauggggggccugccuugcuaaagcauccagaaucccugagaagcagaaacagaggucacgucuccaaaagcccuggccugggcuuuguccucacuguuaagaagugacacaagccaggcuugguggugcuuagcugcaguaagugaucucugugaguucaaggccagucuggucuacaauccuuuagcccugaguuccaggacagucagggcucuguuacacagagaaaccuugucucaaaaggaaaaaaaaaaaaagugacugucucccaagaggugagaauaaugacaagcuugcuccacaggcagaguaggacccugauuaagaaaaaaaaaaaaaaaaguucacuggcuguucccauggccguguguaucuguggccacccaaggcagggcugcgggccagccgucggaacuuugccgaaccaaccuaguuacuuugucuuccacccaaaggggcucucuggacaaaggcucugaacuccaggccaguggcagaauggcuuucccucagcccccaaagucuacucuggucgcagggugcucccaguacuugggcuagcccuaccuccaaaauaauaaaaccaucuggcaggaacucagggcuucccagucguugagaagugaauuuugaaucuugaagcaaauaacuuuuguuuaugaaagaagcaugcagcgcuucccuaauaaccagccagcgugggucagaagaaaaugaacacugaauugcucggcagggaaaugggaggggcuuccuuccugaaaucaaaccuggcaaucauuccucgcuuguuuaauggccugaggaaauaucuggacaaugagacagccacuuagccagcuacgagcuugguauuguuugacuugcuccaauggcacaggcugacuucacuuuuuccucuugccauuuuuugccuuguuuauaaaccggguuuguggcccacgcagacagauaacguggaagagaacacccugugcuuaaaagaaagagcucgaaucuggaccuaugcgaaggucuccagauggugggcagaaccccugacucuuaccgguugggaacaagacagugucagugauggggucccuuccccacuccccaggaccagcagggagaugaguugucacaggaccugcucaggaguggggcugaggcugcugcugaagaacggggucccacuucuacaaucuucuugugggugacuuccucaaaccuaagcaccacugccuguaaaguagaaauggugaugguaguggugaugcggauaaugauggcgaugguggugauagugaugauaaugauagugaaaaugacgaaguaacaucugcccacugggauuuucuuaaggguuaaaugagacucugcagacucaagccaucacaaaaaagccacugucuccuuuaaugaucuuuuccucaagcacucugguaacaguggauacgguuaagagauuuacuuuauuggcucugaaaugcaacacacacacacacacacacacacacacacacacacacacacacacacacacgaaacucaaagccuaggauucaucaaagccaaagcuugacauaggccugggagaaccauauacagaauuauccuaacuagcugcuuagucuguauguaagguuccgucuucucaucaguuaccauuuuuauaaaaagggugucugugugugugugugugugugugugugugugugugugugugugugagagaugcagucaggauaaugucugagaguccaucucccucuccugugggcuucaagguuagaacucaggcacaucuucaggcuugugcacucuugccugcggagucaucucucccagccccauuuccacgaucugcaaacugggugacuucucaccugcauuucugcagggauuaagagaacacucagcucguuccugauagacuggaagugcucacccugagaacucuuuagaaguaggagucagggacccgggcaaggagguggagucagaaaggucuuugggguuacugggggacggaggggggaggggguauggggagauggggggggagcacaagcugagcagaagcagggcagauccagagcugacagcuggcuucugacuaaagcauaacaaguccgcuccucacugagaguguguuaacuuucacguuuaaguccccagacccugcugauggacuagcccuuccugucugugagcuuggucccauuauccagugccguuuucccuaagagagggagaacagaggcaucuggggagagacuuggucuggggccugcagaaaggcuagacacgaggaucccagcuccuugcccuggaagagcggaggaaacggcaggcagcagcugccagugcuggcaaaccuccagcgcucugggcucacacggcuugcuuggcccguuugugcaguuccauccuggcaagggaggagccagagucuuggucuccuaguugggccucucaggucugcauccugugcuaaaagccccaggcccagccaaacaaaauggagaguccaggaagccagccagccuggccacagguucccuacgacgccaggcaaccuuuacaucuucuuuugcccccaccucuguuaaguuccacuuacagcaagguguccucgguccgcagaggguucugaaccgugggccuguguuuccuguucuucagggcucuccuuuugcaaggcucucagcucccgaaucucccagccugcccagcuccucugcuugcaaauuucuuuccccuuuacaaaaucuuagaagucaguucaggucacuucugaguacuucaggaguguccuggucagaaugugaugcccccaugccuccaaauuacuucaucgaaauguugaucugggauugauaaagggcagggagguggcucaguggguaaucaccuguguggcaauugugaggccgugaauucaaccccacaauccacauaaaagccaggcauugguaaccccagcauugagaugggacguggggagccccuugaaacucuugggccaacuagcaacagggaacaauaugagacgucgucucagcugagcagugguggcgcaggcauuuauccuagcgcuugggaggcagaggcagguggauuucuggguuugaggccagccuggucuacagagugaguuccaggacagccagggcuacacagagaaacccugucuugacaaacgagggagagagagagagagagaaagagagagagagagagagagagagagagagagagaccuuaucucauccagaaugggaggugaaaguacuugaggcucuccugauuuccacaugaaccccauagcacagaacugaauaugcacacauuguacacacacacacacacacacacacaagcaaaaucauugguggacuaugaaauccuugggacagagucuguccucuucgggauagagaucuguacuaggucagauaaagguccagaaaccaggaaguggguggugggugacucagacuaccauuuggggcuauuuuggugcucuuuugagacaggucacauaugaagacagcccagguucuucugaggauuacuuugaacuccuuuuuuuuuuuuuaaagacuuacuuauuuauuauauguaaguacacuguagcuguccucagauacuccagaagaaggcaucagauuucguuauggacgguugugagccaccaugugguugcugggauuugaacucaggaccuucggaagagcagucggcgcucuuaaccacugagccaucucgccagcccuacuuugaacucuugauggccccaagugcuguguucugaacauuuaucuccacgccuggcuuuuuuuuuuuaacuuuuuuuuuauuauuacaguagaacauacacaaccuaaaauuaaccacuacauuauuguaaaguaguaucguucaagagcugggguauggcucagagauggagcaaugccuccccagcacuuaaaaacagagaauucaguugcacgagucacauucauaauguaacugucacuacaaugcacucucgauuuuuuuuuccuuaaauucuuguuacauguucguuugcacacgcauucaacagucagagacagcuucugggagcugguucuuuuccuucaaccucuggaucuugggacugaacucaauuuaucaggcuuggcagucagcgagccuuucuacugagccauuuaaccagcccuccagaacuuuuuuuuuuaaagauuuauuuauuuauuauauguaaguacacuguagcugucuucagacacuccagaagagggcgucagaucucauuacggaugguugugagccaccaugugguugcugggauuugaacucgggaccuuuggaagagcagucagugcucuuaaucacugagccaucucaccagcccugaacguuuuuuuuauaaaggauuuguaugcccacacgauuguguguggaggaccaugaggcaaagagggugcuagcuguugcuuaugacuaccuuugaaacagguucucucgcugagccugggguacauauauucuccacuagacuggaaaccagaaagcccuaacacucugugcuccccucagagcuggaauuccaggccauguagaccaggcuggccauaaacgcacaaagaucucccucugccagcuggaugcugggacuaaaggugugcaccaccacacccagccacauuuuuuaaguuaaccaaguuuuuaagcugaccuaaggaccuaagauggccuggugacucacgucuaccaucccagcacugagaaagcuaagaccaaaggaccacugagcuggcccaggcuacagagugaguuucugguucaaaacacaaaaccaaggcagacuagagaaggugucugcuagccacagguccagagggaguuagguguaagcucucuccuaccugaggguuccuuccauuugaucccugugcagcacccaugggacaccacacugggugcacguggguaucgaugcaguggccugauacuacagcaagaagguagagguagugacgacagccucuacagagcaaucauggagagaaaagaagauaggggggggggggagcagaagcugcccuagaagacggagucccaaaggaugguggcacagcucagugcuuuuguauguuugagucgagguccccaauauccaggauagccuagaacuggacuuugaaguugugauccuccugccucuaccuccugagucccgggauuacagacaugaaucauguguggugguaguggugaugcagcuuagaccucaagcauuacacccaagcacccacauucucagccccuuuggcguucucgugugcuguacugguucaauuuaugccucucuccuccggggugaucucuaguccucaggguguaacccuaacucuugucuucugucuuacagagaacggaaggcucccuuaauggaacuuaagacagucaaggcagugcacgucccugggaggucguccaugucccgagaagagcagccgauuccuggauugcgagaguccugugcacguauuuaugagccuguccccaccgaaagcaguaauccuucaggccaagccauccaauuuuaaaccccgcugccuuguucauguuggguauacagagacucagaggcgcuaguuaauggccagccugaccugucuuccuuguguuucggggggugaaaggagguuccaggagaauaaugcccuggaauauucugaggcugaaauguugugucucggauagacagaguacuucuccguggguccuccugcacagaagcccccuucugcucuguugucaaucacuggguuaguuuuuuguuuuguuuuguuucuguuguucucuucuuucuggguugaucuuaaucuuuggaaauacacagugcugcucagguuugccugguuccccugugugaccuucccccccacacacacacaaagucaaccagcugacugggagcaaugcucguggaauggccagucacuugaagacagaccucaagccagcaauggcaacuggagcgagcacuuaaagcgcaccuugaucuuccuuuccguuccaugccgaaggcccaaagaagagaaauggcuggcuacaacaacuguuauuauuuuuuuaauaguaaaaggaaauauguacuuuucucacuaauuuuucuuuauuuauuccccacuaaagaaacgguuuccuaaggucugagcuguuucccagggugggcuagagugggugggcaggagcugccgacauuuuguguacuauaccuaacccuccucgccuucuccguuugccucagccacccggcuccagggccccugaggggaguuguauuaaauaaaauugauuuuuacucuuca

SEQ ID NO: 12492 - RNA, 8140 nt, Mus musculus
accucauucauuuccaucgguccuugcccucgcagcuccggcccucgacaccaccggccccuccgcuggugacgcccccgcagaggcuucgccgucgccgaggccuucucuccgcgacucgucgccgcaggauucuacuuucacuggguuccgcccgcacaccgccaccauugacgccaugucgaguuauucuagugaccgagaccgcggccgggaucgagggugagugugacaagagaccugucaggccgggugggggaugggagagcggcgcggccgaaggcucgccuucccaaccgaccuuuagauuuuuuuuuuucccuuccugaaaggaggccuggcuuuugucacacguccgguuaaaagccguuaaaggcuacgcuucggguaauggcguucaaccuuuuuuuuuuuuuuuuuuuuuuuuuuuuugguccgggagggugggccgggacccggggcggcccggcgaccucgcggcuguugagggaaacccggaggaguguuuucggucgggaagcgccgcgccuuugaggcgguucccggcgucguuugcgcaaucuuucguuggguuguuuuuugaggggggcccccccuuccgguauccccgggggaaagaaggggcgcuuucgagguccccugugccccguuggguggccuacgccggcggauucggccauguggcggagccgcagccacaaaaugccggccucggacauggcggcggcgccuuuguuaccccgcccggcggaggagcucaaaauggcagcggcgagaaaauguggcgcagagagaaaugcgagacaaagaaggaagcgccgccccagcgggaacgccgcccgggccgggacuccucccccgguugcuuucggcuccuccucuuuuucucccucgcguuauauaauuuuguuaccuugguuugcagccguucgcggcguuucccuagacucggcucgcuggcgccuguuccccuuucuacccuguccgccgugcuagccucguucagcugcucacauugccuuugcggccccguuauuucuuuaagauuagguccuuugaugaaaacgggcaaaaauaaccuuccuaagcuccucccuucuugcccagcuccuagacgcuaaugccuaagcucuguggggagagaagauggaggcucuaacucuuguccuuguaaucuggucagauguuugggcuguuugccaccugauaaacccacgauguuuauuuggccucaguagagugugcuugggacuucagaaaagaaacgcugccaguuguggcuguccuuagaaugacaguugggaaggauuccagaagcacacuuuggcucuaucaaaaggcagcagaugaaaugugagggcaaaccuguucaugcaguaucuuucacaaugugcccaacuuuuguuuuguguguguguagguuuggugcaccucgauuuggagggaguagaacaggaccccucucuggaaagaaguuuggaaauccuggggagaaacuaguuaaaaagaaguggaaucuugaugagcugcccaaauuugagaagaauuuuuaucaagaacacccugauuuggcaaggcgcaccgcagugaguuuauaaauguggcuucuucaugcuguaacucaguaacugcuucuagucaauuagauggaaauguaauaggugccuugcaaauggagaguugcuuguggugcacuuccauugaauuuuucuugugauauauggugcccuauuuuaauccugucacuggggaaacagguuuagcagucuauugggcuucauagagacucaauuuucauuuaaauaaguauuauaaauuaauuauuaauuuuuguugccaaguagaguucuuauuuauggguccagauuuuuagaaauaaguauguuuaaaaguuuauugagcuauagggagcauggcagaagucugaggcugagauaauuuguuuuucagcaagagguagauacauacagaagaagcaaggaaauuacaguuagaggucacaacuguccaaaaccuguucugaauuuuuaugaagcaaacuuuccugguaaggacuaacuuucaucuuuauccuuucauuuccccccccccccuugcuuauaaauuuguuuuuaaaaugguauuguugguugcagcgaaugucauggaugugauugcaaggcagaacuuuacugaacccacugcuauucaagcucagggcuggccaguugcucucaguggauuggauaugguuggaguagcucagacuggaucugggaaaacauuaucuguaagucuaggaaaacuugauaaauuguggcagaggugaccuuagauauauaacuauuuuaauccaauuucuauuauuuuuacucuucaauaguauuugcugccugccauuguacacauaaaccaccagccauuccuagagagaggugaugggccuauuguaaguauuaucuuaaguuucccaccauauuugcuaaaacuccuuugacuuucauauagggaauauaggguugccaguauaaacuagccacuuaaaauuaguauccagcccaggcgugguggcacacaccuuuaaucacagcacuggggaggcagaggcagguggauuucugaguuccaggacagccagagcuacacaaagaaacccuaucucggggggaaaaaauuaguauccaaagacaguuaguuggaucagccaauuauagauacuugucaugagccugaucaagaucaacuaccacaaggagagaccaacuugcaaaaguugccuucugguuucuccaugugcuuccacacacaaaaauuuuauccugagaauagugccugggagguagaaacuggagaauucaggagacacugucucaaaaaaaagucuuaugaccaccugaauucuaauucccaacacacgaagacauagggucuuaguaaacuguuuuauacuaaacacuuuuuuuuguuuuucaaacuuagugcuuggugcuggcaccaacucgagaacuggcacagcaggugcagcaaguggcugcugaauauugucgagcuugucgcuugaagucuacuugcaucuaugguggugcucccaaaggaccacagauucgugauuuggaaagaggugugugaccauaaagggggaucuuugucacugauggagaugaugguuuuguguauuauaguuaaagcaucuacuccuuuuuauuuauuuaauuaaagguguggaaaucuguauugcaacaccuggaagacugauugacuuuuuagagugugggaaaaccaaucugagaagaacaacuuaccuuguccuugaugaagcugauaggaugcuugauaugggauuugaaccccagauaaggaaaauuguggaucaaauaagaguaaguaucuuuauguuaucauaaaaaucaguucuaggaaugcucuuaagauugaaguguaacuugcuuccuuaaaucuucagccugauaggcaaacacuaauguggagugcaacuuggccaaaagaaguaagacagcuugcugaagauuuccugaaagacuauauucauaucaauauuggugcacuggaacugagugcaaaccauaacauucuucagauuguggauguaugucaugaugucgaaaaggaugaaaagugaguuuacauuuuuacaaauugagaaaaaucuuacauaaacuaagaguaaucaauucugaaaauugucucaaaauaaaauuaagguagugugcuauauguucuuuuaaaaguccauuuguuggugauauggcuuggugugauaugaagaacuugcuuggcuugcaugaggaaaacacucauaguuuuugaaccuagucacuacacaagcacgcauaaagugauacaccugaaaaucuguaugugugguggcuuaguggguuugacauuuggauucacuaagcaaaaaaucaggguuguguuugguuuuguuuuuauauccuuuuaaaaauggugaguuuuucuucaucuuuaggcuuauucgucugauggaagaaaucaugagugagaaggagaauaaaacuauuguuuuuguugaaaccaaaagaagaugugaugaacuuaccagaaaaaugaggagagauggguaugugguuuccugagucaaagcagacuuaaaaguacuuugaucuggggcuaguguuuuuugggaaucaugcgcugugauauagggguaauuguauggauucguuccagugacuuguaguaggcucuggguugcaaugcuuagugggaaaacacuuggccaagaugaaguacagugggaauagauauugguagagucuugacaagaguuuuaaguuggguauacuacugauaauuuaauucuugguauagguggccugccaugggcauccauggugacaagagucagcaggaacgugacuggguucuaaaugguauguauuucaaauaagauuaguuuguagcuugauaacaucauuugcuugcauuaaugauuauucaugguugucuuuauagaauucaaacauggaaaagcuccuauucugauugcuaccgauguggccuccagagggcuagguuaguacaaacucgaauucauggcuugguuucccagaagaucuccauguaguuuuuuuuaaagaaaguuuauugcuuucuuuaaccugcauuuuuucuaaguuuuuuucacauaaaggugcagucuuuguggcaaggccuaggcaugacaaucggaggacucgagggggauggaggacuagugaucggcuggcugcuuccagucgauuagagaggugaaaagcugaaagugugccaguaaucuucaaagggcagaacauaccaccucugccccauaaacuguucucuccgggggaaaaaaauggaaguuaccucacaguucacugccgugguauuucaucugucccaugcuuugcaugauugccaugguacagcauuguuucaaacuguucacugugaucugugggucuuugaguuucagugaguuugcugaaaugucgaagaaauauuuccaaacuucaauguucaaugaaauuuuuguucaaguuugaaauggagagagcagcuuuaaaagccuuuuacaaauuggugaguacuggcacaugagaccuagagcaggaccaacuucucacacauagucagugggaaaagaaagugccuugaaaguuccucccucaccuacacaguagucgucaugucgagaccugccagagagagacacauucucaagugaauccuggcuucuuggaagcgcuugccuagacgagacacagugcauuaaaacaacuuuugggggacagguauguuuuucuugcagcugcaguuguaaggucuuggcaagacaagcaguguggccagaguuuugaacuucugaugaguguaaugcaaaggaccuuuacauuuuuguuaaaagguccucaaaaaugagcacaugaagagauugcugagaaacuuuuaauuggcccuacugcgcagaagcauucagaugucacuugaugaucuguaaggggacugucaauuugggaaugugcuaaggagaacacacauucccuugauaggcugucaguggguggguguuaagacagcugacaugugcaaauuuuuuuguuguuuuuuggguguuuugguuuuuuuuuuuuccuacccugcccuuuuuuccuaccucaaugguguuccuacaggaaauggauaaccauuuuaacuguauuuuuuucagcccguaccuucuugggaauacaauugucuaacuuuuuauuuuuggucuggcuguuguggugugcaaaacuccguacauugcuauuuugccacacugcaacaccuuacagauguggaagaugugaaauuugucaucaauuaugacuacccuaacuccucagaggauuauauucaucgaauuggaagaacugcucgcaguaccaaaacaggcacagcauacacuuucuuuacaccuaauaacauaaagcaagugagcgaccuuaucucugugcuucgggaagcuaaucaagcaauuaaucccaaguugcuucaguuggucgaagacagagguucagguaaggaucuucguaagagauguuucugguagguggcaguuaccucuugucuacaaagugggaucggaagaaugaguacuucuuauuuugaaaccuaaagaaucuaaaagcacuuaagacccaacauaaauagagcuaucuaacucucuccuaucuuaccacacuuaugccacagauaaaaauugaucaauuuccacuuacuuucuugacaggucguuccagggguagaggaggcaugaaggacgaucgucgugacagauacucugcaggcaaaagggguggauuuaauaccuuuagagacagggaaaacuaugacagaggcuacucuaaucugcuuaagagagauuuuggggcuaaaacucagaaugguguuuacagugcugcaaauuacaccaaugggagcuuuggaaguaauuuuguaucugcuggcauacagaccaguuuuaggacugguaauccaacagggacuuaccagaacgguuaugauagcacucagcaauauggaaguaauguugcaaauaugcacaaugguaugaaccaacaggcauaugcauauccugcuaccgcagcugcugcgccuaugauuggcuaucccaugccaacaggguauucucaauaagacuuuagaaguauauguaaaugucuguuuuucauaauugcucuuuauauuguguguuaucagacaagauaguuauuuaagaaacaugggaaaugcagaaaugacugcagugcagcaguaauuauggugcacuuuuuucgcuauuuaaguuggauauuucucuacauuccugaaacaauuuuuagguuuuuuuuguacuagaaaaugcaggcaguguuuucacaaaaguaacuguacagugauuucaaauacaauaaaugaaggcaaugcauggccuuccaauaaaagauauuugaagacugaauuaagugaaauuguacuuuauuuuacauauauaaugucauguacaacuuggcuuagauaguguuuuugggggggauuuuuguuuugguguuuauuuuuacacaaggaaaguugacuacuucccauuccuggauuuaggagaggaacucagaaggcccuuaggaugaucuguuuguaugggaagaaguuagagacaauggauuuuauaauuccagauuuauuggauaaaagcuuugucauuuuucaguaucagggaaguaagucauuuaauagccuauuuuccuuaagagugaacuacaggacaguaacuauauaaauacauguugauuucuuuugcaaaacaguuuuaaguaaugacauuuuugcuuuaucaaaauuuuauuccaucucuugguuuuguugucaacugccgaaaugugcgaagcugaaagacuguuagcccaagagcugugugcacugugucuuuagugcaggauuaccuuguagguuccuaguccucgaggacuugccagagugcuuauagccacaccuggaagucaggaaugucuccacauuauuucaggggauuuuaggggucuuguaggcuagucacaaggaagacgacauaaccaaaagcacaguaaaguuuucggguuagguucacuaugggcuuaacagcuagaaggauuggggggaaagcuuuagauuuaaguaggaucaccagcaaacagcuuuguuucagaauggcuauaaguaggucuaaaugucuucccaaaaaauugguguguuuuuugcccaggacaaaagucuuaaaggaaguuauuuaacuuuuuguuuuuaaaaugggcuuauuguuaaugccuuauuuauaaaauguuaaaacaaaauagaaugugcugggggugggagcugggcguguuuuccagggcugauaacauugaaaacugguucauccucuaguacugagugguuuucaauggcauggcuagucagauucaugauuuuuaaguauagguguagauuggagcauuuauuacauauuuuacuguucaaugucuuaauguggaccuuuuauuuuguaaauaauuauggaaaugauuguggggcuuggaaaaaauuaccuuugaaguuuuaaaagacaguccacuuuuuagcauguguguuguguccagccugugguugucuuaacuaauaaaugugauuuuucucccca

SEQ ID NO: 12493 - RNA, 3077 nt, Mus musculus
uuucauuaaaaaauagugcucuuuuauuauaaauuacugaaauguuucuuuucugaguauaaauauaaauauaugugcaaagucugaguugaacugggauuugguugaguuuuucaagcaucuucagacagccucgaaggccugaguggggagaggggcgggcuggagguggauuuuuauaaaagugauugaggcaaauuguaaacauuauucaaaacagagagaaaaaagccaccccaacacacagcugccccacccagccccauaccugacuucagaaaacuuguuucuccccaacacaggaccaguuccagguaauugcauggcugcugcauucccgugaggccccugugagcggcaugggaaggcuucuccaucaccuccugccuccccccaggugagaagggagggcugugcagggccuggaggcucucggaccuacugaccgagagaugacuaggacuggccaaugucuucccaguguuaacucaggagucuccugagugacugggucucuccccugcagccacuuccccuggccuguagccaccugggugaaucccucaacucucugccuauuggcuguguuuggcuccuugugugccaauccccaucccugggacagagggcauuuaaggcgagucuccuagccccacauaggagagacaaagcagaacccuccaucugcuccagggaaaccugggcuccaagauggcucaucuguugaucugccucccuucgguguuggaaaaggcggccagcucaccagccucaucugucucccuucuaaaugcuacugccucuucacaacggggaggguucuggggugcaagggaucugcgagguuucauuagcugccccauggagaggagccuggcaccaguauagcucucuucaggucaccccuugccacucuccccagagccaggagccaccacuccucaccuagguugggcagugggagugguuauuucuuuggccagcauaaaaacccuucacacacccuuuucucuuccauccuucccccaggugccugcucuugaucaaaccaaaucaaagcgcaaacaaguuccagcgggaaaguuugaagauuccccuugcaguucuaaguucaacacuuggagguguccccaccucccuugggaagcagaggggguguggaggaaggggaggggagaguccgcuugucaaagguauugucccaccaggccaggccggcuggcuccacuugaaagaagcuggagcugggggaggggggaaagcagguggcagcucccccuccccucagacgaauuccagguccugccagcucuacucugcgggaguggagggccugaggaagaagccaaucugccccuggcucacugggagcuaccgaccguuggggcuggauuuuugugcuugugccaugugccucggaggagaggcgaccgaccgacccaggccccccucugacccuuuugcuccuuaaaguggagcaucauacugauccaggaacucccgaauggguccaggcagcugggucacuuucucauaggaguccagguggccguugacagucuuccgacaaagaugcuggaggguggccacguuggaggagagaggucggcucaguaccagcggaaucuucucgcccccagaauagauguaguaagcucucuuggggguacucccggggagugccugggcagguggcugcuccggaacuucggacgaggguuccguggguggcaaagaaaaggagggggucccuggaggcggcauguaguggugcaccagcuugaguacacagucgaagcggggaacuggcugcgugcuucgggggucacucugcagcgaaaagcugccccccucacacuggaugcguagguucuugguccccgacugggucuugacgcucaacgugaagaaguggcgcugguccgagcugucgcggauaagaaaggugcccgcgggcucggcgcugagcagcagguucgccucgccgccggucacggcgcuccaguagaauccgcucuccugcagcuugcgcacggcguucaccaccagcugguacucgcuuuuggagcugaaggucuugaggcgcaggcugguguccagggggcggcucaucccggcggcgggaaacuugcugugggugaccauggcgcacggagccagcguggaucugcgcggcgguggcugcagcugcuucgcggccuccgcacagcggccgcuaccgcaucccggggagcugcagagagcaaagcgugaggcgcgugagugcccggaacccuccagcgugcccggcccuccagccuccgccuagcgcccggggcaccccuuugccccgcuuuagaccgugucucaggcccagccaccucgcggaacucgacuguccucggucacugccggccaaccccagacagucucuuccccugcccgcccuaggaggacgcccagagaaaacucgcgcguggaaguugggucuccaggagcgcggccaggauggggagagacacaagagcccuagggacgcucagggcgccucucaguccgguguccucaguggcgagggcgaaaaaaggggggugccaaacccgagauaugugagagaggggacaggagaaacccgagggccccagucugaguaugacgggaaucagggaucuucgguucucauccgcucugcccccuaccucguccccucccuaccgggaaugacccgggaaggggaggagaaaccgggaaaagcucccgagcuggaccgaggcccccacccuuccccacaccgcgccccuccuuccuaccuagucccgaagcgaaaucuccggccuuggggcugcgccuccuaugguccccgaggcgaggcggcggccagcaguggcucgcgcugcgcccagauguuggcagccgugaagucuacaaaggggcuccccgugcgugcgcccccucuggcuucgcugcuccccgggccgaugaggcgcacuccugggcgaaucaggcaaaggaccugggcgagggaccucgacggagagcugggccgggaagggggcguccgggagcccggagagacagcggucguaagagcaggcgag

SEQ ID NO: 12494 - RNA, 3077 nt, Mus musculus
cucgccugcucuuacgaccgcugucucuccgggcucccggacgcccccuucccggcccagcucuccgucgaggucccucgcccagguccuuugccugauucgcccaggagugcgccucaucggcccggggagcagcgaagccagagggggcgcacgcacggggagccccuuuguagacuucacggcugccaacaucugggcgcagcgcgagccacugcuggccgccgccucgccucggggaccauaggaggcgcagccccaaggccggagauuucgcuucgggacuagguaggaaggaggggcgcgguguggggaagggugggggccucgguccagcucgggagcuuuucccgguuucuccuccccuucccgggucauucccgguagggaggggacgagguagggggcagagcggaugagaaccgaagaucccugauucccgucauacucagacuggggcccucggguuucuccuguccccucucucacauaucucggguuuggcaccccccuuuuuucgcccucgccacugaggacaccggacugagaggcgcccugagcgucccuagggcucuugugucucuccccauccuggccgcgcuccuggagacccaacuuccacgcgcgaguuuucucugggcguccuccuagggcgggcaggggaagagacugucugggguuggccggcagugaccgaggacagucgaguuccgcgagguggcugggccugagacacggucuaaagcggggcaaaggggugccccgggcgcuaggcggaggcuggagggccgggcacgcuggaggguuccgggcacucacgcgccucacgcuuugcucucugcagcuccccgggaugcgguagcggccgcugugcggaggccgcgaagcagcugcagccaccgccgcgcagauccacgcuggcuccgugcgccauggucacccacagcaaguuucccgccgccgggaugagccgcccccuggacaccagccugcgccucaagaccuucagcuccaaaagcgaguaccagcugguggugaacgccgugcgcaagcugcaggagagcggauucuacuggagcgccgugaccggcggcgaggcgaaccugcugcucagcgccgagcccgcgggcaccuuucuuauccgcgacagcucggaccagcgccacuucuucacguugagcgucaagacccagucggggaccaagaaccuacgcauccagugugaggggggcagcuuuucgcugcagagugacccccgaagcacgcagccaguuccccgcuucgacuguguacucaagcuggugcaccacuacaugccgccuccagggacccccuccuuuucuuugccacccacggaacccucguccgaaguuccggagcagccaccugcccaggcacuccccgggaguacccccaagagagcuuacuacaucuauucugggggcgagaagauuccgcugguacugagccgaccucucuccuccaacguggccacccuccagcaucuuugucggaagacugucaacggccaccuggacuccuaugagaaagugacccagcugccuggacccauucgggaguuccuggaucaguaugaugcuccacuuuaaggagcaaaagggucagaggggggccugggucggucggucgccucuccuccgaggcacauggcacaagcacaaaaauccagccccaacggucgguagcucccagugagccaggggcagauuggcuucuuccucaggcccuccacucccgcagaguagagcuggcaggaccuggaauucgucugaggggagggggagcugccaccugcuuuccccccucccccagcuccagcuucuuucaaguggagccagccggccuggccuggugggacaauaccuuugacaagcggacucuccccuccccuuccuccacacccccucugcuucccaagggagguggggacaccuccaaguguugaacuuagaacugcaaggggaaucuucaaacuuucccgcuggaacuuguuugcgcuuugauuugguuugaucaagagcaggcaccugggggaaggauggaagagaaaagggugugugaaggguuuuuaugcuggccaaagaaauaaccacucccacugcccaaccuaggugaggagugguggcuccuggcucuggggagaguggcaaggggugaccugaagagagcuauacuggugccaggcuccucuccauggggcagcuaaugaaaccucgcagaucccuugcaccccagaacccuccccguugugaagaggcaguagcauuuagaagggagacagaugaggcuggugagcuggccgccuuuuccaacaccgaagggaggcagaucaacagaugagccaucuuggagcccagguuucccuggagcagauggaggguucugcuuugucucuccuauguggggcuaggagacucgccuuaaaugcccucugucccagggauggggauuggcacacaaggagccaaacacagccaauaggcagagaguugagggauucacccagguggcuacaggccaggggaaguggcugcaggggagagacccagucacucaggagacuccugaguuaacacugggaagacauuggccaguccuagucaucucucggucaguagguccgagagccuccaggcccugcacagcccucccuucucaccuggggggaggcaggaggugauggagaagccuucccaugccgcucacaggggccucacgggaaugcagcagccaugcaauuaccuggaacugguccuguguuggggagaaacaaguuuucugaagucagguauggggcuggguggggcagcuguguguugggguggcuuuuuucucucuguuuugaauaauguuuacaauuugccucaaucacuuuuauaaaaauccaccuccagcccgccccucuccccacucaggccuucgaggcugucugaagaugcuugaaaaacucaaccaaaucccaguucaacucagacuuugcacauauauuuauauuuauacucagaaaagaaacauuucaguaauuuauaauaaaagagcacuauuuuuuaaugaaa

SEQ ID NO: 12495 - RNA, 23749 nt, Mus musculus
uuugaaauaauauacaagaauauagugugcaaaauugaggggcaauauguuuaacaaguguaaaucaauuuuacagcugugauuacuaaccaaaacucucacuugguaaguaacaugagaagccaugauuguagcucagagcaagagcagcaggacugcugaaguacuugcucugucucagaagccggagggaguaaagugcaaguggugcacugcaguaagugcaaagucugccccaccagagacacacugacagcacagaugaggguauguggcugaggagacaggaacgcggucaaacacaauggugucgacugguaacagcaccauuacaaugacugucccaaugcuauuaacugacugcaccuuggccuggcuugggccccacugggaaucauggagcugugcugcccccuggugcauccacucagcacaugcccaugguaucugaagcagguggcucuuugagcugagacaaugacaccgacaccauccaccugccauguuauguugucucuuggcacuggccagacuagaagcaacuguguuuggcagagaugcugggccaugugguggcuauucauggaaaggccagcgucugcuucacuccugauaucguggguacaauacagauuaauaagcaguaaggagcugauguauaaacagcaguuacguauuuuuaaauuccccuucguacaauuuaaaauaaaacguauacacaucuuucuacuguacuuuagcaccacaggauaucaauuuucaagccuauauuaccugauagauauaugaaguuuggaaggaaaauaaggcaauuugguuuacaauguugauaguuauagcuuaaugcucuaauggagaaagcaauccucacccauuaaaucauuacaaaacucaaugcucccagcauuuuauggucacacaaauguagacaaauggugagaccaaggucuuccaagcuuuuccauccagagucaguacuuaugcagaugcagacuuacaaacacaagcaucagguuuaaugcuguugagagcccuguggaaacaaaauaauugguucucaguuuccuaauggcucauagcuuaaguaucuggaaaauuuaaacaaaugugagaccagcaugcacagaaaagugcuaaugucccaaaugaaguuccagacauuagagaauuuguagggaauggcugugugguuccauagauauacuuugccuuuaagcacagaaccuuggguucaaaccccugcacuaaauaaaaggcggcaagaccaacacuugaguuuguucugugacuugaauguacacauacacagaaccugagcuuguauugcauagcuguaaucccugaaaggaccgcaaggguuggaggcggaagcaucagaaggugaaggucauccuuggagacaaaagcaaguuugaggccagccugggcuacuuaugaaaccucgacucacacacauauacaccaaaaaacacagaacaaaucucuacacuacaguucaucugguggcugacccuacuuuaaaauaaaucccugagccauuuaaccuacaaauuauauaggauuggcuaaacacccuuaauaagccuucuuucugauuaccguuccaauaaucuucauuuuaaaaaaauaauacauaaguuuauucuagucuauccuauguauuuugugcuaaauaaucuaaaauguaaacauaaaggaugcuauucaaguaaagaacaguuauaagaauggcgucuaccagccaaagacagcauugugaaacuucuuucucauccuuccugugucuccuaguuucugccuauagcagaagccugcaaggauguuaccaaaaacuaaagaucuucuacuguaaugaguuaaugauguccaucuuuuaaccagacuacuaguaguauacucuaaaacuuccucagcacuuggggcauucuucagcuagcuugagaaaaucugcuugcuguacuacucaagugguucuugauagaaaaggcagacuccaguauuagguuugaaguauaauaauggugagggaucuuuaagacucugccugccaucauggcacaagaacacacagagcaucagaucaggacuucuguuacuacuaacacuuacugaguugguucuuuuccuuuuccaacagucaggauuuaaacgcuuuuguucuucagccaaagccuuugcuucuaauguguacauccuccuuucuucguucuucauuuuuuuccaccugucaccaaggaucacacuuauggcucugcaaaguaaauauuuacauaauguaaaguuucauaaaauguguagcagcugcuacuacuuuggggagaaauguaaaaaaaaaaaaaaaaaaaaaaaacagaaggggaaagaucaagacuaccauggucauuucaacgaaauccuggcauaugcauccauuuaucaguugguggaauaaugauaguauuuacaauuguucuaaaacauccaaaauugccagaaaacuggcaauuuuccaaaggaaaguucagugucagcagcguggggcauucaacuuguauuaaaacuuauuuugugugcaaagcuauugugguuaugauaauaaaagcuuuacuccccccaugcagugcaagccaaguaagaaagacuaucuuugcuuuagaguuuaugucuagugaucuuuuuaaaaguacauuuuaggucagauuuguacuuaacacaagacacuggaauaaauccaaaaggguaagagggagucaaaguugauaggacacauuacuguacaaacuucagacuauuucccuguuuuccuagucauucagauaccaaaacuauuagcagugacacgguagcacacaagagccuccugagaaagaagacagugaugcuucaggggcacaggagccacaacuaaaauguagagaaagcgcuuugucuugugaaguccaacacaucaaacaauugaaugugcuauauuuuauuuaaaaccaacuuauacaguuucugauuaaagauagcauaaaauagcugacauaucugccaucuaaaccacaggaauagacacauagcagucucagucccccagaguuagaauguuucaaauggggugcugaugcauucuugauguuuucucuuagguuaaacauggcgggcagugugaggugcgcuaugauucagucuagacuccuuccucgcuuaaguuucaaccucauuaauguauaugccaacuggccuaauagcuuucuauaugucuacauucugccccuaagaaaaaacuuccuuauucauggaauaaagaucuaccucuauagaagaaaaaaaaacccaaacugguuuuugauuuggaaaaagguccauuugacucauuucccguuaauguguuacucauauacaaacaauacaaaaaugcaauggaaagugagaguuaugaguuauaugggaguuaucuuugauaaauagauccuaaaauagaaaaacaaaaaaguggaaaugagacagcuacucuuaagaaagaccuuuccuccagaauuaaaguaaacccagagagcuauuggcauuccaguguuuacaaagucuuuuuaauauaauacaagaacacaaguaccauuucuagaugucagaggacacauuuaauaagcaaguaccagacagguaugaaaagagaaacacaugccccaucugucaggaagucucuaagaugaccugggggggggggguaagucauucuuaaaaugcuuuuacauuuuagaaguauguuuucugcuaaacuauaauauauuccugaccagagacuacuccaaugugaauuaaaaaaauuacagggucucacuacuuagcccuagcuacccucaauuccaguucuaaagaaaucaccaaauacuaggacaaggcuauucuguacaaacacaucaacucuuaaagaugcacuuggaaugcaaagcuucuuucuaaaauguagguaguauuagaauuacuucuuugaggagcuggagaaauggcucagcaguuaaaagcacugacugcucugcucuuccagaggacccagguucauauccuggcacccacauagcagcucauaguacaaucuauauauuauaaaaacuauauauguaaagucaacauaagaaaaugggaagaaaucaacaaacgacacugaaggaguuuauuuugcaggcacaguuacugugaacugcccugacaagucaagaguugcagucauuacuauuuuauuuaccuguuaucuuucccuggauacaucugaguauauucaacucuguauuuuuuggcaaaaagcaugaaggcauucauuggucuuuugcacuuauuaggagaaguggcacucacagucccugagcuguggcuuuugacagcuuuagcauacaaagaacuagaagagagcugugaugauccaggugaaccacagcuuuuacugaauucagaucccgaaaacucuugaccaguaccagguccuccuccacaagacagagaugcacggcgcugacgagccauacuacucaaaacauagaccgcagaagaguccauaggugugaagucauagcuagagaauuaacaaaauuagacugagguuauaaaguaucuaagacagaaauuuaaaaaucuugcauuugacugaaaccuucacugccccuuaccugaugugucuuuaccagcuucugccacuacacuuaguaggaaaccucauauaugcaacugaaaacaucuuuacaaagccaaccucuacgccccacaaaagaagucauaaccagcauaucuccuucauagcaguuaacgucuacagaccccauacguguccuucgcuccuucacucuucuagauucacuuuuuaacaaauuugaucaucucauuucuugccuagaaguauagaccuaggaaacuaaaauggagugggcuauaguucaggccugaaagcuaacugaacaacaagagcuaguagaggagggcagccuguucagcccaguacuccuagcauuuagaaaacucaggcagauggaucucuacauagaggcaaaccugagcaccacagaagguucaaggccaaccugcccuaagaugagaccuugucuccaaaacuggcuauggaaugggauaacuuaaacaacauagcaaugugagauuuguauagauacagaaaguuguaauauauucagguccaccuauguauaguuaguaucuuaacccacccauaucaguaaaggccacauucuguuauauaaguucaauuugcauaagcaccaaagcaccaaaacaaacuaggcauaguccugcucuucagcaagccuggaguuggggaguccaucugguccucuauaugaagaaagaggccagccaaaauauaaugccaaggauccucacccauaaaccaguaccuucauaauuccaauggaaaaauucaaaaguaaucaagccaccaccauauuaauuauuaacucaaaaaucaaagcuaauauauaucauacccuuaaacuaucugaagcccuuaccaaaugaaguuuaauauaaaauccaguaaaauaccaguagaauagaguaagcuaguuacuaaaauuugaaaacucuaccaucuaguggagaaaucugucauuucaauacaaauuaauuugguuucauaaacuuaguaaccauacccagaacaagcacugaagcagugacuauauucucagacagcuuacaugccucgccguacccgcugucagcaccuuuaauccuaguacauguuggucuucaaacaccuuccauguuuagguauacucuccccuuuuaaagauuuaguuuauuacuuuuaacuguguauuuggcaugucuacaaacagaugccuauggaggccagaggcaauuuggggcuugaguuacagaccgcucugagcugccugguauggguacuuagaccagcaccuggguccucuggaagugcucuucaucagugagccaucuuccaccugcuucaucacuacucugaaacacacucuacaauaauguagagccuguuaauaaagucacauggauuaacucauuuagucuucuuacaugaaucacuacuaaagacacuaucuuuguacaaugaauuuaaaaacuacagaaaaguaacuuuacuacacuguaccuaagcuuccacagccagccuucagugcagccaggaggacgagaaggcagauaguccagcucuagagcuuaugccccuaccaggcccaaggcuugucaggcaagccuugaauuucauagugagccugaaccaugagcacaugaugucauuuuaaaacuggaauuuugguauaugccaggaagagaaucuuauuuggccaggcuaucaauaaaaaaauccugugucaugagagucuaacaaacuucucugacaaaaacauuucauacauuuguauuauuuauuccuggaagcuuaagauaugcugagagaagacucaaaaaaauagggcuuguuauuucuucugggguuuucccuucuuugacugcuucguauccuuuugccaucauaaacugugacaugaacauagaugcauuugucucaugaguccaccuaguacaauccaguuuagcaauauugauauggccugugaacaauucaguuacagagcuauuuacauaauuuuauacucauuuacaacaauuuauuuuaugagccagcaaaaugagucuuucucaacugcucucuaucaucucuaacuggacugacaagcuaaccagcuugcuuggcagagcccuugccuccuuguucccacugcuggaaucacaggcaggccacuacaggggaugggcauacucggauagaaagggggccagugcccaaccccuuaaaccuuagcuuuaguuggacuucaguuauaacucagcuaucacuagggaagaaacuuuaacagaaaaaaaaugcaucuuuaccuuuuaaauguaucaaaaacaccugaaucaucgaaauuaauggcaucaggguguccaggagguagacauacgucaccaauaugaauuucacaacauggaaugccaugcuguaccacagucaagcuuggauaaaaugacgaccaaccuagaguuagacaacagaugaacaugaggaaaaaagaacaagucuacuuaggucugacacaccacgucucucacuuucaaauaaaaccauugcuaggauuaacacuucuguuucagcuauguaaaaacccccacaacuaguuuaauucaguauuuuauuuauaaaccucuaucagauacugaccacuuuuaaacaucugcaaaaacacugaaguaauaaacuaugaaauagccuacaaauuaauaaauuaugcuuuacacgguauuucuguaguaaagcucuaaagagcaacucuggcuuaauagguaaauacaaacaaaaauaaugacuaccaagcccaccacuucucacauuauaccugagagcuuacaguaugcuacaugaaugacauuucucaugcacauggcaacauuuuuucugaucauggcuaagguacuuaaacacuauuaaauauaacuguaaacaucuguugaauuuuauuugguuugaaauaaauuuucauuauuuuucuuaaagccacaaaauguaagaaguuuucuuuaaaguuuuuaucaacucggagcuaaagauggcucagcaguuaagagcacuggcugacccugucucgaaaaacaaaaacaaaacaaaaaagcacuggcuggucuucuagaaaucugggguucacuuggcaacucacaaccaguuguuaacugaaguaccaaaguaucggauauccaugcaggugaaacacgcacaaauaugaaaauaauaguaaaguugguauaaauucaauugaagcccuaccuuuauuuuuaacauagaaagggugguccagcuugcacucuacagugagcaagccaucuucuacuguaccaggaucaaaugucaacuucaguacagacucaccgaaugacacacucucuucaugggauaacaacuuuagaccaucagacccauagcccugaaagcauaugcauggacuaaauaaauuggaaacauuccauucaacagggaaacucccaauauaugucuggauuggaaaagguaaauuuagucaguaucuccagcuuuaaaguaguuucaaccaagcaguaaagaaacacacguaucaugaccacagaauauguaucagauugagauaauaugcauuuuaauccaaauauaaguaauaugaaguuuaguaaacaaagacuaucuaugauagacuaaggaggacuuugaagugagauguaaaagauaaaauuuagaaaaagaaaaugccuaggcuaagaauaguugcaugugcuggacgugguggcgcacgccuuugaucccagcacucgggaggcagaggcaggcggauuucugaguuugaggccagccuggucuacagagugaguuccaggacacccagggcuacacagagaaacccugucucaaacaaacaaacaaacaaacaaaaaaagaacaguugcauguaacuucuuugaguagugcuaaguaaguaguagugcuuaaaaacaacaacaacaaaaaaagaaaaaagguuaaguuuagacuuacgcaaauaaggcugaaaaugggacaguuuguaaguuuguagagggcaagaugaaaucucacucaggagguguuggugguaagacaauggaaguauuuuuauuaaugugguugucaauuuucagaucaugaugaugaaaaagggacucuacuauguuauuauuuuuaaagguguaucguauuuguggguguacaagcucuaguagcuguauguguagguacuacucuagccaucuuucuagcccugcauuuuaauuauuugagguuaugagauacccacuguacaucuugaguccacaacugaugagagaagaaccagaugaaacuuaaauucagugggcauuuacugaguaacacaugucagguggugggcuuacagaacacaugaacaaggugaaaagaaagaaaccagugucuacccuugcauucacagaaaaagacacaugacugcagcuagcuacagcacccaauuguauacuaggugaucaacacauaauggguuaacaaugcugugaauacuauggaauagaaaacugaauaugaagggaugagaaggaacauaaugaaagacaguuucguaguuuugaauguggucugcaaaaauauuuuaaaggaauuuuaauuuaaagaaauacuuagauaggcagaaauuaggaaugagauguaccccaagucauacugagugugaaaaauugaucauggcucacuagugaggucuaacaugcagguggaaaaguagagggcagauuaacaaauagucaaaauuaguuuucuagggcuggagagaaggcucuuuuguuaagagcacuggcugcucuuccagaggaucuggguucaauuucuagcaucuacaugguggcuuauaacuguuaacucuacuccaggggaucugacacccucacacagacaugcucaugaaggcaaaacaccaaugcacauaaaauaaauacuaaauguuaaaaaaauuagccuuuuuucuuaaagcuacuaagauuuuagccugcguuuacauuacauaucaggaugcgaaggcccagaugauuaaagucguucacauaagacuugcuggaguacacacugaguucagagugcucucuacagagaugccgccuggaugcugcugucagugcuccagucacuagggcuaugaagaggaagacacugcagcaauaagcaauggacugagaacuaggguacugcugcuguguaaacuaagggacagcaaugucaggaaguaguucaaugagcaaauguugcagagauuucaaaacuaggagacaaauuuuguguaaaguaggagaagcaaaaucagacugcacacuuuacuaagaaaagaguaacaccaagaugaagacaccaugcucaagauaaucaacuuuuucucaaaacuugacaggagacaggaagcuccaagaaggaauuuucaauugguauuuuauauuaucccauuuugcuuauuuauucauuuauuuauuuuucccugcaacagagauagagaaaugaaaaguuuuaaaaguaaaaugugucaacagauauuuauucuaauguugcuuaccacuguuuuuacuuauaaauguagaaaaugagaguuuccuggggucauuuaagaaguaaccucaaacucucaauuaaccauggaagacaugcacugcauuauauacuuaagaacugaagguuugaauuaguuuacuauuugucuuuaaggcuagucuaguuuuccagaacaagagcauuuaaagcauaaagcugccaagucacacagaccgcacaccuuagaagcauggcugggaagugcuagucaugguucugcccaccaugcuaagcacugggcggucucacucccuacccagagggcaaggugccauuuaaauaggaaugcaaguagagcguuccucuagauuaacccugaagguugaccaguuugaaauucuuuagaaggauuuuaaaugaaccuugugagugcccauuuggaucucuuccucauuaucacagcuggcggcucuagcaaagucuuccacaucuugccauuccuuauugcuuuccuuauggaagcacagccgcgugccugaaguugaauuagaaagaagggaucagauuacaagccugcugugcuaccaaggcagcugcaaaucauuuaaguacuucuuuaccuuucagaaagcagugccaaaugguggauggccaggaauugcaccagcccagaucaucaucaucugacagggaggacauacagaaaaugccugacucugacucacuguuugccuguacagagaaaacagaaacuucuguuuuguuauuuuuaaaagaucuuuuaauaccucuuuuaaacucgagcuuucaaauaaauauaacuuaguuguaagauuaaggaaaguaagcuuucacuauugaaggacuuuuuuucuugaaguuuuaaauacugucaucuguaauaaauuuucuuaaaaauagaaauacagaaucaaaugcauauaaugaacaaugaaauauuuuugugcaucuguauguucuucaaaacaaucucucagauuggggaaagguaauguuuucaaccacuguauaaacuuuguagaaguuugacuucaugaauaaacucacccuuucaugucuuacugguguuucuuccuuccaguggucaugagggaaggcuggcccacuuuuugaagaagaggacacugguggugggcgugcauaggaauguaaacuuuugcuaguagcuaugauguguacaggagaugaucuaaaauaaagcaguuuuuauuaucaguguaggcagguccauaacgaacaucuuuucucuugauaacagcauauugcuaaugcuguuacacaagagacaacuauggaaagcucuaguaaagacagcaagcugucccuugaacuuaucauuaaccuuccucauauauaaacucacugguauauguuaaaguguucuuucuuaucgaagacucaucacauuuucuuaagcuuuuuaaaaaucaaaaguggcaaggaacuugggauuuuccugccccaaggucagggauugcauguauguacacuacaccugauucccaucucuuuuauucccauacagauaaauaugcauaucauuaugaaguaaauacccaucuauuucuuaacuccgaaaacucaacaguacuaaccuggccagccauguaucacugggugaacugccuuaaguaaaacuacaaauagaaaacagccugcuugccgggcgugguggcacacacaauuaaucccagcacucgggaggcagaggcaggcagauuucugaguucgaggccagccuggucaacagagugaguuccaggacagccagggcuauacagagaaacccugucucaaaaaaccaaaagaaaagaagagaagagccgagccuguuuccauuuguaagaagacacuguuucugugaguuacacauaagcauacagauguaccgucacuuucccacaaggaucacuuacacacuggcuuccuucccuagcaaagucucuacugagcagugcucuuucaagcccagcagggaucccaaggacacacuaagcucagaaggcuuuagacaccaaccuucaguaauucacacaguuaacagcucaugaguacuugcacaggucaucacgaacagugauguaaaacagggaagaaagcaggacuggugagcagcagagaaaacaccuccaagaauaaaacuacaccccgggguacagucccuuaacuucugcauuuauaaucauucuccucuuggcuuacuacuucccaugagccucccuuucucugcaguauuacagagaaacucauguuuuuauccugcacaugcucaguaaacucucuucuacagagcugugccucagcccuucuauaaacuguaaccuggaugugaagaugaaagaaugguaauacuuaacaucaggguagcuuauuaguaaaguucuucccagccugcaaacugcccuagguuaaacagauuacugugaaaaagaggaauauagaggaaaugauacucugaaagagaaauuuccuucccuauggaaauuuacacagaauuuaacugaauugaauugcucaaucaagaccaaucuccugcaaaauagacaagcauaccuuaacagaaugcaagguagcuaggcuuucauguuuauaucauguguagcacaauauuguacaacuggggaccaauaccaaaguccagaguuccuucuacuuggcuagcauagucucaucuaauucuuccaacagagugaaaacuggggcauuucuccaagcuguuauauuuaguaaaaugauacuuacuuaggucucccuaggaauaccaacugggauuuuccauaguuucaaugcagauuaacccauuuucuugaccuuuggucuagaugaaguaauuuuauuacugggacucuaaggugguuuuuguuuaauguuuagauuuacuuccauuacguauaugaguguuuugcuggauugucagcgcaccaugugcgugcccggugcccaaguagaucagaagagggcaucagauucccuggaacuagaauuaacagagggcuggauguaaacugccaugugggugcuaggaaucaaaccugggucaucuaaaagagugcucuuaacugagcuacaucuccagcuccuacuuuaagaucagcaaaccucagaauuagcgaagauaaucaagguuacacacacaauggaaaaauaauuauagaacacaaugaaacaaucuacaguugauaaaaguuuaaaauacauuguuuaauuaugguucuuuaaacaaauaauuuuuauuuuuaaaaauuuauaaaaguagacaagagugaaacccugucccaaaacaccaaaaaauaaauuucagaaugauauaaaaauuuuuuuauaaaaguauaaaguauuuuuuuuacuuuugaaacacauauuuuuaugcuauauuuucucauaguguuauuugauuuucaaaacaaugaaaucaucuuugaucguuauaaacauuaauuccagugacuuuaaacauuaaccauccauugaauagcuaaugccauuacuguaaaauuagaagauuucaaaacaguaacuuuuugaaauuaaaaugucuuuuucauuuaugugugugcacaagcacuacagcauguaugaagugagaggacaacgugcagguuugcgcccucaggcuugguggcaagcuucuuacccacugagcuaccuacuaucuugcuggcccuaaugaugcaaguuugaaaugcaaacauaauccaugcuccuaccuguuauaaaaugagcacugcaucaggggacuuuguggacuaguggcaauauuugcuaacucuguuagccaguccaccucaucuucacggugaguauuuuccgguauaucugagguauucuggcuccaagaugaucuuggauauucuugaugagauacaucugaacuuagcugguauauggcagauuggguagggucacuuugaacagccugaaguucaggaaggucaucuggaaauaagcccaagauuauuauuuuuuaaauauuauaauuaauaauauaguaacuucaguuaggaauauacauauuuaacuaauuugcuaggaaaaauaaauucaaaauuaaaaccagucauuuguugacagaaaaaauuuucaauguaagcaauaccuguccaugccugcaggauaaacacaauggaugugaauacagcaaugguucacugccugaaacauuuaacuagaagaggucagaggcugaaaaucaagguucaguuuguuuucuauaccucaucucgaucuauauaccagauauguuccuacguuaacagauuaaugaagaaaggggcauuuaauguauacauauaguuguuauauauaaacuuuauuggcuuguuaaacaaguaacugcaauauugaaggcaauuccuaacaaugagaccagagagcauacugucaaguuuucaguagugcuacuuaauacaaaucuacuuuuuugugaguuggguaucaugauacaugcuuaaaguccaguauuugggagguucagacugcuggacuccaaguuuguagccagcaccgguaauacaagacccugacucaaaacaacaaagaaacagagaaaguggauucuauuaagucuguuuucaguucuuuuauuuagcuggacuuggugaugcaggcuguaaaccaguauuuuaagaagcugauauagaaaagcugauagagaguucaaugucagccugacaaucaaaacaguaaggcaguauucccaauucucuauuuagugcuaccuuuccccagugcauuauccccaaagguagaucacagaaccuagcuguuugaaggaaaaauuaggaaacuacccaaaauugugaaauucguuaaaagauggggugggaggaggggaggaaccucacaggccuucuaccuaccuaccuaccaaccaaccaaccaaccaaccaaccaaccaaccaaccaaccaggcaugguaguguacucuuuuaaucccaguacucaggaggcagagacaaguggaucucuuggaguuccaggcuuggucugcauaguuaggacaaccagagcuacauaauagagauccugccucaaaaagaggaaauacaaaaaacaaaaacaaacaaaccaacaaaaguaacagaaaucuccucgaaaaagcacucacacacaugcacaugcucucuacagaucugcagggucccuuaaauaugcaaggcaggaaaaacucuucuaagggcugcagagauacucagcaguuacgagaacuggcagcucuucuagaggacccagguucaauuccaagcaucuacauggaggcuaagaacggucuguacuccaggaccagaucuaauauccucuucuugcuucuuuaggcaucaagaacccauaugguucacagacauauauuuaggcaaaacacccauacauguaagauaaaaaagaaaaacuuuaaaaauuacauacaaauaucaauaaugaaagaaaauuccuuauaaaguugugccaucaccucguuuggaacuucuacugaaaaaguauaaucuaaucucaaauaauccuuucaacuguaucuuccugaauaaucaauguucuguacuaucccucugugaacauuaacuauucugcuuuaugcuauguaguaaugaccucgcuuuaccauguuuuuaaugacagcagucuguguuuucuuuccacaaggcaauggagaaucaaagaaagugaccaauacaacaggaaagaaaaaccucaaauaccucaaaaacucuccuauucaacuaaguauccccauaaacuguucuagaauagaccccuaaaacuaaaguaucuuaguuaaaaauaguaagugggguuauccauccauucuuugacuacacaguauccaucucauugaaaaaguuauaaagcacaccaacuagauucuaauugccaauuuuuaggcugcuauaauuauuucccuuaccucacugucaacacccugccuuuaaauauaucauuucuuuauuaugaaaaguuuuuguuuuucagauucagauugguuuuucuagacaggguuucucuguauagccuuggcuguccuggcacucacucuguagaacagguuggacuugaacucagaaaucugccugccucugucucccaagugcugggauuaaaggcgugcgccaccacugccaggcuaaacuacuuuuuaaaugaagccacagauagguggggcaagcugucuggccugauuuccucuggacaagugcuauaacaauggacaaucaaccauugccaaaagcauugcuccuuacucaauaguaacuacuacuccaaaaacuauuaagauccagaaaauauggauuauuuaaaguuauacagucuguccagagaccuuuaggaccuccaaauucccaaccauacaguaccaccaucauuuauuuguaaagccaaggcagucaugugcuacacccucucauuuccauaaacauucaugaugauaaagucagggugaagaguggaucagcaagccaaaggcccucauuaacucuucucuagaacagcaaugugcaagcaacuuaaaaucacuaaucaauaagccuacacauucuacaaacaucucucuggaguagcucaucagaaauaaucacuacgaaugucugauccucacauuucauggguaccaucauuuccauaucagaacagcaagccaccauggagagcucacuaagaaaguauaaagucacauggcaguuuucaaaacaaagcauguaauaguagaguuugcucuugauacgcaaaauaaaacuauuuacuuaacaaauuuucaaucucaaugaguaccuaaacacucccacuguuuucaguuauauuuuaguggagacuuccuccucaacacugaacagcauggggacucaaguuuggagcuuuaccacucacacaagagcuacacagcaggacaagaccugucuauaacugaagggagucuggggcgugagauaagagcacucugggcuuuugcuagcuugccagucucucaacuggugagcucuugaguucaccgaguaaaugaaaaggaagguggagaguaacagaggaagauccuauccagagcccuggacagcacucacaugugggccaguguaugcacaugugugcacaugcuacaccugcaccugcacacacacacucagaacagaaagaauaugaaaaauuccuauuacacaaguucuuuacauacuuuuuuagguagacaagacagguagaacagcugauuagauaugguaauuaaccuggaucuaagugagauuauaaaggaacuuuccaucuugcuuaccaagcuccaugugcucaucacaggaguuguauccuggagaggauggcaaauucucauuacacugcagcaacuccagcgagucacucaucccuggugcucucuuguccaucaccagcaggaguuucuguacugcauuaggcaucugauuugucuucacuucccacaccauguuauggugcuccgacuagaaaugaaagaaaggcagugucaugugacuuggacaguacacauaaaaagucagucaguaggucagcacuaugcugcauuucaaauuaaucacacaucgccauuuuauuuugcucaacuccuccaggacaacugcacaacugugcuuaaacggacucauacacaaaucucaaaggauuaacauuguuaauucagaaucuuuucccuuuaauaguuaacagcagaauuguacaugcuuucacuuuucugaacugucucuucagauacaaauacuaacaauucauauuucagaaaccaaagaaaauuaugcccaaccaacuuuccugaaguaaagacuaaaggaucuggggauaguggcacauaucuuuaauuccggaacuaaaugggcagaggcggguagauuucugagaucaaggucaguauggucuacauaacaaauucaaggucaguauggucuccaggacaaccauguauaccuagugagaccauauauuaguauauuagaacagagauagagcaaaaaaaaaaaaaaaaaaaaaaaaaaaaaaaaaaaaaaaaaaaagagcaugcuaucuaucacccuagguacuuaugaguuuaucugaaagucugaaguauucuagaaaaugucuuuauuuuuucccgguuacuacaacauuguaauucaucagucuuagcccacaguuacacuguugggauguuauuucccauaaauuaccagauuaaauggccagcuuaaauguaacuucucaacuauuaaaucaugcuuucugugccucucuacccaguccuucaaacacugagcaaauuuaccuuaaucagugauucucauucaccucucagcacagucauacauaugccaaaacaacuguugcccaagucccauccagaggaaaugauuuguuuguaccaaaaaccuguuuacugauuuuuauuuguuuucaaaaacccaaguguggcgaucugagaauugcugggauuaaaaaaaaaugguuguugggccaggcauugguggugcacaccuuuaaucccagcacucgggaggcagaggcaggcagauuucugaguucaaggccagccuggucuacagagugaguuccaggacagccagggcuacacagagaaacccuaucucgaaaaaccuaauaauaauaauaauauaauaauaauaauaauaauguuaacaaguugggguaauguagaggcaauggugugccaccaccugccugucaugucugacuaggguucagucaucagcacaagaacauaacuuccuuuuuaaccauaaaguuaauuuaaugaguauuauacaaggcacuacaauagcagcaacaaugaacaguuagccagaacaccaagggaucagggcuuuagcauauagaauagaggaaaggugggcucccaacaagaacacacaucagcaacagaugugguaaagugcuacuggaugaugucaggaauauagaacuaguaucacaaggauguuugauggcccugcgcauugugugcucauggaugcuaaagccguaaagugagguagagugagucuuaaucauaauguaaggaaaugaaagaagagacaaggguauggacuauaaaccagguuugucaaaugcuaggcuaaaugcucugaacaauccauuuuaauaucuugccuuguuuguaaaauggaauuaaaaguacauacuucaaugguuguugauaaaacucaaaauaaccaaaaacguuucaaacacuaacauaaaucccaucuucaguaugaaaugguuggugucauuaacaauuaccagucaacaggguuagagccacuugugauuugugggccugagaucugacgugagugaaacuacaaacuauuucuuucaaucuguucaaaucacauuaaaacacuauuugaauagacaagguauguaacacaugcagguuuuguuuuguuuuaagagcucucauccucaauuuuugucuaagccaacugcuuccagaguccuuugcaagcucuuguaaaaggcaaucguaacgaugcagacuccuuaucuagucacuccuaagacacagaacuagccauucuuuucaaguucccuccaaagcuaauacuaacaguuuggaucacacagauuuuaacuuauacuauagagaucuauugaacuuaaagaacguaauucaaucuaucguugugauuucaaauccuucugaacaucuguacuauguucuuuggacugaacaagacuuuggcuccagcugcaccuggaaacagcccacuucaccaucauugucaguuagccuuugucucaacaaugcuguucugaguccacaggauccucccuggagcugucuugguugcucucccccugcagagagccauucuucacaacuaggucuuccccucuccccaucaacaggcugcagugaagaucacucaacauggacaauauacuaacuuagaauuucuaccacucaggauuucagcacuugcccuauuuaucuuaucacaacauaauuguguauggggggaauccugacuuuaauuuuagagaacuaccuacaauuaacaggccaagugaauauguacuguuuuggauauuugcccuuccaacuacuuauggugaauuugguuuugacguaggcuuugcuaauguuuugguuuuuuucuauaaaguuuugauuuuuaagguuuuuauguccuguacaggaaaagaaagucuaaacuugcagacaacucuucugguugcccccucccucccacuucuuggcccuggcaagacccaugggccucucuuuccacugacuucugauacauacgcagcuagagacacgagcuccggggguacuggucaguucauaauguuguuccaccuauaggguugcagaccccuuuagcuccuuggguacuuucucuaacuccuccauuggggacccugugauccuauccaauagcugacugugagcauccacuucuguguuugcuagacccaagaaaauuguuuucaaagaacucucacgauagaaaucgaaguacuuaaagugaauuauaugcuuacaagugacaaaaggcacuaaaacuaucaaauauugacuauuauuuuauaaaaauauuaaauaacuaaguaucaaauucaauguucuauaucaaaagcaguuagcagacuuuacugcaguucuuuaauaauauucuaaaugucucuucucugacaaguguuucuacuacucuagcuugccacugagcuaagaaaugaaaacaagaagccacacuguggguuugguaaacuacacugcuauagcuuacacuuacugcuuaauaccgccuuugugcuuugaacagucuaaccacugauaccuauuuccuuauuugucaauaaacugaaaccuauuuacuccucaaaauuguuacagguauaaaaaauacauuucacauccuccuuugcugaacauuacaaaucacaucuaagaaaauuauuuucauguucagucaacaugaaacacuaauacagacuguaaccguccaugaaccaauucaaguaauauuuaaggcaagucauuuugaagauuuaagggcuaguugauuccuuuuucaggggccguggguucaauucccagcacccacccacaucagcuaacuauggucuguaaacuucaguuucagaugguagcucccacuaccucuucuggccuccuuggguacugcaggccauguacuacagagacagacaagacgacaaaaccuucacacgcauaaaauaaaaaaauaaaucaauguuuaaaugaaauguuuauaugacagaaaauacucuccuaaacuuaauuacaauccuggacauuuucauauuacgacaaccuguaaaacagccucuucuuuuuuuuguucagaccuggugggcuuagcacucaggaggcagaggcaggaagaucacugugaguucuaguccagccugucuauacagugaguuacagaucaccaaacaagcaaggcagcauuucuauagcagcguuaauagcuuuuuauuuucaaggauugcuaaggauggaagacugacaggaauucaaggccagccuggauuagacaucagacucuucaggacagguaguucaaugaagacuaugccaucugucuucucucucucucucucucucucucucucucacacacacacacacacacacacacacacacacacacugaaguaaccaaaaaaaguaaaaaaaaaaaaaugcucuaauaagguuaaauuuuaaauuucacucuuuuuuucaaguagcccuggcuggucuggaacucaguauguguccaaggucaugacccauuuuucugcuuauaccucccaagugcugggguuacagaccagguauggguuuaaaaaauucuaacuuccauaaugaaaauguaauauaaaguaugaccaggaguaaaguaaaugcagaacaaaauaugaaaguacacggaauuauuacugacuuuggguaguaacaauugaaaugauucaaauuuucugaauuaugagauuuguuuuccccuucuuguacacaugugaaauuuaaaacacagaaaccaucugccguuguuuuauuagcaguuggggaauaacaggagaacuuguaagagaguacugacaucuuuauuuccagccgauacacagaccagauuguggugcacacaaagaaccuucaggcccagagucuaaagauaaaauacaauagugauaaucugacgguauauuaagagcggaacaaacugccuuucaaguucacuugagaaauguaugacaaaaaaaaaaaaaaacacugagagggcauccuuguauuuaagucagggaaguuaacaaaggaagggcuuucccaggaagaaaagauaaauagguuuauaaaacuaaacugggagcuauaauagaaaaaaauuuaaaaagguucugaaauuuacuagucgaguugaaguaauguucaaaagccuaagguaucucgaaaacuugucuuaaguuuucuuuuuucaauguaacuccacuucccccaauacucuugguucgacaaagcugggguuaaagggagaggugaaacaccggaaccaaaacacaaaauuacggcuccaaaucaccgcuguaacuacuuaaguauuuauaauugcuaaaaucauucuucgacuguaacccauccuaaacccccgccccucucccuagagaauaaagcucccuuaagcccaacugagucccccccagcagguacaaagugccaggaaccgugucccgcccagcugucagugccuucgccggcugagaagucccagggagugaacuccggagcgcucagcgccgggagcacgcgaaagcgaggcucgggaagccggcugcgccccaacuccuuuuuguuuuguuuaaaucggccugcagagggaggagccgggccucgcccgcgggccuagucgccgggucaggccgagcagcgccucccggagccggccaaguccacccccaccucuuucgccauucaucgcuuccuccccucccccccaucaugugaccgcagccuggacgccaggcuuguuuuucccccuuagcgcagccccaccgcgcaccgcgcaggcgccucggagcccauucauucgaacugcguaacaaugagccccgggcccgacggcuccgcgagcucccccgcccggcccgggccccggaggcagcuucgccuccccggagcccccggcccgcuggagcucgcggccggcguccgcccucggcccccgcagcggggaguggcgaggcaaacuuuccggagcccuccggagcgccaggccccuccccugccccggccccuuccccgccggcccccaccgcgagcgccaccgagccccgagcuccgccacccccaccaccccgaguccugggagccgcggccguccaggcucggagagcucccgggaggcccggacggcggguuccgcgcaggggauccagugcccagagucccaagggucuccgcucucgcggccgcugcccggccccgaagcuccagccccucccuugcccaccccccaccccucagaaaccccgcgaccacacagagucaggacgcaggccgucugucgcgacagcgucgccagcugcuugccugcgcguuucccgacggcugcccaccucucuguggcgcgccgcgacucccaccgccgcguuuacuccucagccgaaacuuuccuacuuaccaaacccgucgccauuaccaagucuuuc

SEQ ID NO: 12496 - RNA, 2726 nt, Mus musculus
ccucgccagccagccgccagcagccugcagccugcacccgcucagccccgcacagccauguuucagccagcugggcacggccaggacugggccauggagggcccgcgggauggccucaagaaggagcgcuugguggacgaucgccacgacagcggccuggacuccaugaaggacgaggaguacgagcaaauggugaaggagcugcgggagauccgccugcagccgcaggaggcgccgcuggccgccgagcccuggaagcagcagcucacggaggacggagacucguaaguggcgccgggcaccggugggggucgcgcggggccugcagcgcgcucgggguucugcacggcgagggcgccgggguugcggggcgccggggcugcggcgggccgccugucuuccccccucccccuccuccccuguccccggacccggagucgccgagcgcaggccggggggggcggggcggcagcggcggcgaggacgcaaagucccggccuggcagcgguggcgcgcagccgccgggcgccgcgcggccgcgaggggaaguacagggcguuccgggcggcggagggcgggccggucuggccggcgcccgcccggaggggguggggcacggaaagucccugggcggcugccaggaacacucagcucauaauaaccucgcggaaaacaccgcggccgcggccuccagaaaccccggccuugcgcaauccccccuccaaccccaccuccagcccgcgccucccccccccccacgcagugugcucaccaccccucgggggguuucccugucaucccucagguuccugcacuuggcaaucauccacgaagagaagccgcugaccauggaagucauuggucaggugaagggagaccuggccuuccucaacuuccagaacaaccugcagcaggugcgcugcuugcuugccccgcgggugcccucuuugaccccuugguggagucagauguagcacggucgcccccaaagcguuucuaaauuaauagucacuuaguucuuaucugccuuggccuuuugcauucaaaucagccaacgucuuagaaccagaagaaaaaucccuuggguuuagugaggucuuuaugacccaccuagggccuccuguuugccugaucuccuaagagacaaaugggaggaucagauuccauagcgggaggugucugggguucaggaaacucaagacuauggguuugcuccauggcuuaucccuuucuguuuccucuuccauuuguagacuccacuccacuuggcugugaucaccaaccagccaggaauugcugaggcacuucugaaagcuggcugugauccugagcuccgagacuuucgaggaaauaccccucuacaucuugccugugagcagggcugccuggccaguguagcagucuugacgcagaccugcacaccccagcaucuccacuccguccugcaggccaccaacuacaaugguaggucugccaguccauccaaggaugcagaggagggagagagauggggccacuugagucuuaaacuccgaacguauacaaaguucagacacugugaucuuuuuaaaaaguuuucuccucgaugccuauaugauauucacucagaacccagauucugaguucuucaaaacugaugauguuugugguuguccucaagacaauagacaugaguugugugaggauugaaacacguaguuacaguuuuugucuuccuccuccaggccacacgugucugcaccuagccucuauccacggcuaccuggccaucguggagcacuuggugacuuugggugcugaugucaacgcucaggugaguacaucucccuuccaccuaaucucuguugggcuggcucugauggugagcagguuuccagaugcagccguaaacuaacgccugauugcuuuugguuucaggagcccugcaauggccggacagcccuccaccuugcgguggaccugcagaauccugaccugguuucgcucuuguugaaauguggggcugaugucaacaggguaaccuaccaaggcuacucccccuaccagcuuaccuggggccgcccaaguacccggauacagcagcagcugggccagcugacccuggaaaaucuccagaugcuacccgagagcgaggaugaggagagcuaugacacggagucagaauucacagaggaugaggugaguguuccuccccucagcacgcugacggcuguucuagggcugcuuuggaucagagggauuucaguuguuuaacuucucagacucggcuugcaaagccaggaucccaagaauuugucucugguuuguuuuaagagcuuacccuuuuggguugaggaaugagggaauucuagaaauugaacccaggccuuagcacauggugauaagcacacguucaaccauuaagcuccacccccucaauagcuuagacuuuuuuuuuuuuuaaggaaagaauagguaagggaaacuccuacagccuggugcccuuguucuauuuggguuaaggagaaaaagagcccaagaauaggaguuauuucagcagcagcucuccccuuaucccaaugucuuggugaaguucuaggaauuuaauaugucuuuuuccccucucuuguuuuagcugcccuaugaugacuguguguuuggaggccagcgucugacauuauaaguggaaaguggcaaaaagaauguggacuuguauauuuguacaaauagaguuuuauuuuucuaaa

SEQ ID NO: 12497 - RNA, 40761 nt, Mus musculus
ccgcccggaaggucggcgguucggucccagcgucccaacgauucuugaguuccuuuaucggucccgcgggcgcggccguugcaggcagcgcggcccgcacgcgcugggcgaaucugccgcgacgaaucggcaggcguggcgccggcggccucgcgagagugcggcgcagacggaggcggcgcgacgggccuugcgggcugagggccgcgggcggagagcggacugcugagcggcuggggggccgguggggccccgcggcuccaccaugacgggccgcgucugccgcggcugcggcggcacggacaucgaguuggaugcggcgcgcggcgaugcggugugcacgggcugcggcucggugcucgaggacaacaucaucguguccgaggugcaguucguggagaacagcggcggcggcucgucggcggucggccaguucgugucgcuggacggugaguucugcagcucgggcgagggggccgggcagggcugcgugugcgagguccgagggaggagucgaggcuggcggggaaacugaaguaggucguccugugacagaccgugggcagucggacagggaaacugaggcagggccgggccgggaaucugcagccagguccccuccgagucccguacgccgauguaaacuccgcgaucugcccgguccaagcgucgcgguccgguccaacggaggucgucgggcugggucccgaaaucugacaggcacggcuuucaggcucgcagguuccguuuauccgguuggccacucuaacaggugucauugcccuaagggcuaugaagaagaugugcccagccucaauucucugcccagucgccugaguccuuaucuuuuuaaaauaaggguuuguuuccuaaccguugaaugucgagucucuaggugaguuauacuuccaagucuuucuuuguauaucugauucuugaggcaaauguuacuauuuugaccaaagguuuuacauuuugaagcauuccaauuugucgccuuuucuuucuugagaguuuccuuugucacgaaucuaagaugucuuugagucaccgcguuugucuucuaaaaguuauuguuuacacuuuuacgcaguuuuguuuuuauuuucuguagacuggggaucuagcccagggacucuggcacacuaaacaguucccaaaucccuaugucaguggaagccuaguccacauuuuuugaguuaagccuuguggaaagugggaugugcgggcugaggcuccuuucuugucugcggagguaccauuuuccacacauaguuugcugaaaggauuccuuuuuuuuuuuuuacauggaguuaccauuguuccuuccgcagaggucauugucugccccccugugugagucugcuccggguucuguagugcauucagccugaccuuuuguuuacauuuaauguuuugcgaucagaauugugagccauccagcuuuugccuuccucuauggacuaguguauuuguaaucucuuucccuuggacuguauguaacuguauuugcauauuuauauguauuguguguauggagcuggagcccaggucuugcucauacuaagcaagugcagugccacugagcucucuauguuccuagcuuuuuaugguuuacuuugaguuaggguuuugacaaguuguccaggcuggcuuugaacuuaaucaguaacccaggcaagcauugagcuugcaguccuccugacucagccucuuaaguaguugcaguuaugaaccuguacuaccagacccaacuuuuuggguuuuuuuuugagacaagauguuccuguguagacugguuggccuugaacuuuuagcagccuccccugccucaguuuccuaaguacugggauuacaagcaugcacaccaugcccugugcggcugaggcuguguguguggugugugugugugugugugcacaggcauacauguaugugugggcacaugaguaaggaggcccaaaguuggcaucaggaacccuccuugauaguucuccacuuuacugagucagggucucuugcugaacuuggggcuccugauuccggcuacucuagcuaaccagguuggccaagggauuaccacucucagccucccaacugcugggguuauaaguggcuaacacuccugaccugcuuuuaugugcauccuggggaucugcacagcaagcauuuacuccacugaccgacaggacugucuccccagcccgugcagcagauuguugaaucugcugugaguuccaaaagcaagcucaccugaggcauuguccugggguauuggccuguaguuuaacaucuaucagccuuagaugucaagguaaugaauguacuccugaaacaagugagcugugucccugccuccccacccccccuuacuuucuggaagggacuauauacaaacaaugcccucugcgcucuuucucuuuccuaguuucacuauguaacuuaagcuggccucgaacucaugaugcuccagcuucagucucuacacagccgagauuguaggcgugugccuaccacuucuugcaucuguucuuacuuaaauauuaagguuucucuguguagcucuggcuguccuggaacucagaaauccaccugccucugccucccgagugcugggacuaaaggcgugcgccaccacagcccggcuuuuuuaacuuuuuuuuuuuuuccaauauuaagguuucuuuuucagcuucugucauaguaguagcuguaguuacauuucagauagucucuggcuuguucuuggaaugggucaucuaguuguggaauucauggaguuaagcaaguagugugcaacugagcuuucucccuaccuagcccauguucuuuaugucugcaagggacuguagcaaagccccuccauuuccuuuuggauauugggguauuguauuuuugccuuucuggcugguucaccaguuuugugaauauuuccaaaaaaauggcuuuggguugacuuuucccuuguacauuuccauuauguuucacaugucacauaaguucuuauucuuuguagguguuugcaggacuucuaugacaguguuguaccacacauuguuacagccuccuaaagaguugccaagauguugaugccuguuggagugauaagagcaguaggaacaggccguugcuggagcagaugucuagggcuuuccaugggaagcauuuucauagugcauucacugcuuggggacaguguguuaugcucacugugcccucgugacaucagggagaacaguguggagccaugguggagggaggcuuccccaugcauccugggaaaucaugcucagaggcauugagcagaagcacagaugggcucugagguggcaucaagaucucucuccagagagaagcacuccagcaaccagcccugggugcccuggggaaugcacugugaggccaugaauucuuagccuugguaggaaguacaggagggaggugucaguugcuuugaacagccaucuuucagguggcuaccugccugcccuccccugaaaucagcaugcccacauggacuagacccuccucggucuucuugccuuccuccagcuucguuguaagccccuuuucucguuaguggcugucuuuuccuaggugucucugcuuacagcaaccuaagcuggacacugaacaguagaaugugugccucguacacuaaagugagugaugggguccugcagcagagccccugacucuggaaaauguuguaccuguaaucaggguuuagaggucuuuucaaguagcuugugccaagggaaguaguaggcaucaggaccucaggcuuagaugccaaaugcaaggcaguggguagcuggagaaguugggauuugagcgacaccaugagagucuggagcaaagcacuguuccccaugaugcacacucugcagcaugagccauggcucucugaggccucccuuugucugugggugaugaccccugggccucugcaugcuugucaaagcuuggaacugcgcuuaggauugcagagagagagcaaacaccaggcaccuuguggcaccugccuucuuaggguucauuuucuccaauccuggagcagcaaaccucaucugaaggcugggaaccucccugagguuccaauaaucagaauugcuuaugguguuggugguggaacccagggccucguguaccacuugaucagaacuuaauuuuuuucuaugaaugcagcuuuauuaaugugccuucaauagacagaaaucacagccaccccauauuccaaaaggaaguugaagaaaaaaguuaacaaaaaagagcccacucuagggaguuagaaauccugugacaugccaucccugcguugguacccagaagagagugugaucaagacuuccagagcuuaggggaguccagggucauuuugggaggagggcucgggguucugcgugguauggaguaccuuucccauuccuuaugccaggggcacauuaacuaagucuuaggccaaagucugacccauagcuuccaacaaggugagacccagagcuauggucccugacuccagcucagaugugugggccucggacagcugccggagcuccaucucaugccuucaagaaaggaaccaagccccaaugucuccuuucgucaguuucagugccucagccaaggccuccagagcuuccucauuaggguuagggucugucuccaacugcuuuguuagcuccuggaacugcucaugaaagacccacaaugugaggauucucccauguucugacucaggagaggcgacaccccaaaucacuuacgagaaacggucuugaugcaaacugcaagagguuuauucgggaaagaccagugcacuagggacgacucguaucccaugcagggguagaggagucgaccacgagcucaagggguaagggguuauaaagguagaaaccgcaaacacuuggcauugggcuauagcauuuggcaagcuggcaaguuugcauaacggguuuaaggaacgguuccuggaacaauggggcaaguucuacucccuaccauuagugaggucuauuuuggacacaggucuaggggcuuaaauaauuuuucucucucugucaggaucuuucacccacaggugaacccauagcuucuauccaugcaggaaagaccuggaauugucuccaucucaguuacuucuaucuuggcugaagcucacuugaguucuguucuucaguuuuucagaacuuacauuuuuauuauguuuauuuguauguguauguacaugccacucugcacguauagaauucaggggacagcucuuggaagcugguucucuccuuccaccuugcagguccuuggggcucaaacucagguggucaggcuucauagcagguuucuuuaguguuaagccaucucagcugcuguagaaugcuuuuuaaggaugggccuuacugucuaucuagcccaggcuggccuuagaaucucuugccuucucuaucaaaccagcaguuauaaaacugucugcucuggguacucugagaaaaugaaggacagugcucuggggaggccuuucugggcucugaggucucuuggcccucucccucagucagauccagcaugugaagguggcuuugucuguuucuucccauguugucuugggcucaucucucugagcccuuucagaggcucuuccccgaguggccugugguuguauaauccuucuccauuguccuugauggacucuuaaaagcccaucugugcuacaccucuagcuuguauuuuuuuguuauagaaacuuguaaaaaaaaaaacaaaugucuguugggccuagugguauacaucuguaaucccagcacuuggaaggcaaaguuguaagucagcuggugcuccauagugaaaccugaucuggaaggaaugaaggaaaacaaaauuccuggugucuuaucuauuuuaugcauaugagaacaccaccacugcucucuuuggacacaccagaagagggcaccagaccccaauacagaugguuaugauccaucaugugguugcugggaauugaacucaggaccucuggaagagcagucagugcucuuagccgcugagccaucucuccagcccaauaccuggugucuuuacaggcagaacacaucugaaaugugaaggucuaggugaauuugagguuggcaguuccauguagaggucaugcuuggcuuuucuuccuucacacccgaggggagccugagucagcuggcaccucauccuggugugacguuugcugaguaagcaccauguuuccuccugcugcucagauguggagggguggcaggggcagugcagguggagcuacccaagcagaaguguggggcucccagcacgggaaguggcagugguuggugacuuugcagugggcuguguggaccuggagcugaggagugcaaagguugcaguaagcuuccaacugaagaggaguuuuucuuuuuuguggggguuagcgguagggguagggauaacagagugaggcaaggucuugcccugugucucacauuggccugcaccucugauacccuaauuacaccuaauuacagaccugcaccaccaugguuuuaaauguagugaaauuuuuauguuuucuuuuuaagaucuuaucuuuauuauucuaaauuaucuguaugcaucucugugugggcacauuagugcccaugcccacgguggccggagcugucagcugcccuuggagcuggacucacauuagugcccgugcccacaguggcuggaggugucagcugcccuuggaacuggacucacaggugcuugagaacugucugacccagaaccaauuuugcauccucuuuaagaacaguaccuucuugccgggcaugguggcacaugccuuuaauccuagcacucgggaggcagaagcaggcagauuucugaguucgaggccagccuggucuacagagugaguuccaggacagccagggcuacacagagaaacccugucucgaaaaaacaaaaaacaaaacaaaacaacaaaaaaaagaacaguaccuucucuuaacuguugacccaucgcuccaauccuaugauugacuuguacuaaaagcccaaaagcacagauccacuucauuuagaggaguaggauauuuuuuucuguuuuuuuuuuaauuauuauuacauuuauuugaggggugggguggggugggggguuguggugcaugugugggggagacaguugucgagucaguccuccccuuuuguguagguccuagucaucaggcauggagacaggaggacuagauacucacuucauuaacucaggcauggagacaagaggacuagauacucacuucauuaaccccuauuguuuuauuuuuaaauauuuaggauaccucuggucaaggccacaucuggcuaggcagagcaaaguuagcugcugcucuuccugcuggguccugcuuugcucacaguugguggaagggccuguggggcuucuccccagacucuggcuaaccugucuuuuuuaucuuuccaggugcugggaaaaccccaacccuaggagguggcuuucacgugaacuugggaaaggaaucaagagcacagacccugcagaaugguauucccuacuucauccuugcugaccacgggugggacaggagagggaggaggugggacaggaugcuggggucggguaagagcagaccucacuugcugcuucuacuuugcaaagcccacagcccugccugugucuuaccuugugaccugcuacuuuuugccacccuuacaacccagggccagcaggacucugggagggaugguuccuggaugugccccuucuuucaggcauucugcagaucuugguagggccccuuagugaagggccugagauggugccagccuauagcuguuuguuccuggucucuuggaaauuggcauagagccagcaaauguguaaugguuugacaugcaaaagugacauuucauuguguuauaaaagcaucagagcagagagguaucuguccugagccuuugcuuguuguuaauuaggguauuugccuuuagugaaugcuacaagauuuuuguuguuguuuuagacagggucuccaugcagcuuuggcuguccugaaacucucucuguaguccaggcuggcccugaacucaacagggaucugccugucucugcuucccgaguucugagauuaagggcguacaccaguacaccucauuuuagcuguaaguuuuugaaaguaaauagcuauacacauguacaugugcuuaccguggcgcauucaugagcaccuugcaggagaggguucucuccuuccuccgugugagcucugggcauugaaguccugucauucaccuuggcugaaagugucuuuacccacugagcugucuucacacccucugugauuuuuuuuacaccggauauguguuauagaaaaaauuuuccuguuccaugagcugucuuuuaacugcuuuucuuuuucucauuacuugguguuauaaaauagaaaaagauuuauucuaaaauguauauggguccaggauagccagggcuacacagagaaacccugucuugaaaaaccaaaaaaaaaaaaaguauauggguguuuuauguauguguaccacacgugugccuagugcucaggaacauuaauuagaagaggauuagaacuggagauacagaugguugugagcugguuguaagacugggaacuggacuuagguccucugcaagagcaguaagcagcugagccaggcuccggcuccguggugguuuuggaggcacacuuucuucauucagacagugccugcuucccuggugccucacuggucacucacuugaugcucaggggacagcuugguggguagaguaaggcugaguuaaggucuccaguugagccuguaaaaggcuaagcauggggaugugagccuguuguaacgcuggcucuggggaggcagagauagguagauucuagggccucagugcauagccacucugacaaaaacgggaagcuccagguuuagugagagacucucucagaaagauaaagugcagaucacuagaggacccaccagugucuaacucugcccuccacaagugugaucaugggugugcaugcaugcaccuaucacccccaccccacacccugcucuccaaacugaugcuuauaucuucuguucucugggguugaccaucugaguuuccuguuauguuuuugggguugguccuugugaguuagaacaagugauaagagacuggguccagcuuccaucuuaugugcauuuucaguguuugagugaaaagauuauauuuucccaguuggcacccucccuugcugagaaucauuuccagacccucuguucuguucugcuggacuauauaugucaugcuuuuguuuggcuccuagccuugugguaaguuugaaauugggaaguguuuauguuucuuagaauucuuucuuuuuuuuuuuuaaaaaaaagauuuaguuauuaauauauauaagugcacuguagcugucuucagacacgccagaagaggucgucagaucucauuacagaugauugugagucaccaugugguugcugggaauugaauucaugaccucuggaagagcagucagugcucuuaaccgcugagccaucucuccagccaccuuagaguucuuucucagugcugugcugauuauucuaaguuucuugaucuguguugcuugcuuccucccucuccucucccucccuuccucccuccccccuucuuccuaccuccuuccucucucccuucugcuuuuugagacagucuugcugugauagcccaggcuagccugaagcucaugauccuguuugacucucgcagugcugggcuuacaaggccuacaucaccaugucccauaguuucacuaggaaguuagucugucuguauccgauuucugccaggaaaucagcugggauuuugagggcuugucuucaucuguagagcguugugagaguaugguuacuugaaugggacugggucuucugggguuauuuucucauugauuugauucuuuagaguuucauuuuggaguuauuuuguuaacuuuacuaaaggaaaccugcccauauucuaguugggauuacauuggaucuauagaucaaauuauaggaacuugauauggugagcuaaaauugugaacuugucuugaguuucuuuucuuuucuuuuuucuuuuuuuuuuuuuuuucaguuuuucgagacaggguuucucuguguaucuuggcuguucuggaacucacuuuguagaccaggcuggccuugaacucagaaaucagccugccucugccucccaagugcuagguaggauuaaaggugugagccaccacugccggcuugauuugaguuuuuuuuuuuuuuuuuuuuuuuuuaagauuuauuuauuuauuauaugaaaguacacuguagcugucuucagacacuccagaagagggcaucagaucucguuacggaugguuaugagccaccauguaguugcugggauuugaacuccggaccuuuggaagagcagucgggugcucuuacccacugagccaucucaccaacccccuugucuugaguuucuuauuguagcuaccacacaugcugugagcagaugucacugguccuugcuuuccacuguuguucucacuuauucucaaagcuaugcugcauuuuugguuguuuguugcuaggcuccucagaguugcugagaccggguaggcuugcucauugcugaccuccguguggaaggaucaguguuuugcucuuaggagugaugucauuaagugugucguaugcugcuuaguaucuauuacagugagcguauggauucuguuugugggaugcuggcaagcccuagccuggagguguggggcuuuagaauuggucuagccuugagcaggggcccuagagaagggcuaucuuaccuuaacuguggaaucuugcaaacacuacacagcuccugagucucaggcuccaguucaguguagucugcugucugcugauuauugguggguuuuuuguuuuuuguuuuuuguuuuuuuuuuuguuuuguuuuuuauuuugccucugguguguugcuacugugugcugguaagaaaaaggagcugauuuuugugcauuuggucaggcauauuagccaugcccugaaauguguuauuguuacuguuggcuaugaguagugugcuagccuucaguucuuaucaacaaaucagagaaaccaguauuuaacauuuuaugggugagauggagguugccuacacugucagaagagugcauugaggcccugaagaugcuaguaggacgagacacgucuggugacaggucuuaccaucuacauguccucugcauaucuuaggguauaucuugugucugguggagcucucuuaaucccuggcacccacccauuggucugcacuuacaguugguaucagcagcucucucuuagaccuacacugcuggacuuugguguggcugcucuguauuugcacuuguagacagagaccuugaguguccugucugcagcauggugacuguccagaccuccuggcagcaggugcuucugcagucgugccugccuuucccaucgcucuucuucugcaggugugcagggagcagcucauuaggcuguccaguuguccagccaagaggcuggcucuuggagggaagccuggcuagggguuguccaggacugaacuagguagagagaccuuuuuggaaaguaugagucuugugcugugggagaccccuuccugccagacacuccaggccucagaaucuccagaagagauaacagccacuguguauuguucuaagccaagauauaguguaucaggaauaggguuuuauggcauaugagaaaucaggaaacuaauauuuugacauucauaaugaaaauuaauuagaauauaaaggcuaaauuaaaaacuuuagggcaaagauaaucuaucagugucugucugucugucuuacuuuggauuacugaguccuaaaccuaucacuguguguucuaagccagucccaaguccucuaccacugagccccauuuccaaacgugauuuuacgaaaaaaauucugacuuuauguguacagauauucugcuucuguguaugucuguguagcaugugggugcuggaaaucgaauccaaguugaauagaagaagaauagccagugcucuuaaacucugagccaucucuccagucccuaguuugacuuuuaaauuucaucaaauuuuccaggcuggcuuuaaacucauucuguagcucaggguuuuuucguuugaaacggggucucuaaguaacgcuggucauccuagaacucauuugcagaccaagcugccuugaacucacagagaucagcuugccucuguuaggauuaaagguaugcaucauuaugccuggcccaggcuaggcuugacauagugguccuccugccucagucuccaaaggaagugaaauuauaugccugcacuaacaggcuuagcucaaaucuuaaauuuguaagauaaccugugauacuuaauuuuaaauuaaaaguugugaccaaaggucauucuguauuuugccacagggcggcgccacauccaccaccuggggagccagcugcagcuaaaccagcacugccuggacacagcauucaauuucuucaagauggcuguaagcaagcaucuuacccgaggacggaaaauggcccaugugauugcugccugccucuacuugguuugccgaacugaaggcacaccucauauccuuuguugggugauuacucaaauguugacggaggaguuguaggaauugguauugcuaugcuaacaggucccuuacuggaugucccaucccugcugaugcagcguuccuucuccaagcuucuguuuuaguugggguuucuacugaagagaagagauaccaugaccauggcagcucuuauaaagggcaacauuuaacuggggcuggguuaugguucagagguuugauccauuauccucaugagagggagcauggcagcauccaggcaggcacggugcuggagagggagcugagagcucuaccucuggaccaguagucaccaggaagaaagagugacacugggucugcuuugagcuuuugaaacuuccccugaugacaaacuuccuccaacaaggccauaccucuaauaauaccacucccugugagucuauagggccauuuuuaguagguagucaggcuagacuucuaagucccagccacuuuuggcagaagaggaagagcucauggcuucuggcguuguuucuucccuuugcaguuuuguuucuugagauuucaggucugguucuccugugcacuucccaggaccagcacuaagcucugcaggcaugcacauacaucagggauuccauccuucauccuucaguaucuccuagcucccucugguccacagccaucuguuccugucauaugcacacugcuuauagcuguucucuccucaccccaggggccuuggugcgcuucugucuaacugucaacaugaggugucuucucuccacuccaguaggucccucccucugaccacuucccaccuugaaccuguguuaggucacuugguuucuaccuguuuccucugccuguccuaccuguguguuagguaaucuuugcuuccuucuuaucuaucuacucacauuuuggccugagauaguuucuagauuauauucaacauaguccuuuuauuuuugauuggggguauguggcacacacaugguacauguauagcuacaugucagguuaagaggaccacuuauguuggccagugguggugcaugccuuuaaucccagcacuugggaggcagaggcaggcagauuucugaguuugaggccagccuggguuacagagugaguucuaggauagccagggcuucacagagaaacccugucucaaaaaaaccaaaccaaaccaaaccaaaccaaaggaccacuucugagagucaguucuccucuuguacuguguaagucccagagaucaaauucagguugucagguuuguggcaagcaccuuuagccacugaguuaucucccuggccucucugcacuucauuuuugagucaggguauuucacugaaguuugucauuuugucuagaugagcuguccagcaagcccccaggaugugcuaucuccacucaugcccucuagugcugggguuacagauguucacuuccacacccagcuuuuauguaaguacugggguucugaacuugggucuuuaugcuuguguagagcucacuuuacauacugagcucucucuccgggcccagcguucuuuaacuuccuucuccugcugucaucuccucccucacuccuaggacgugguuccugcugucaucuccucacuuccuaggaagugguuccugcugucaucuccucccuuacuuccuaggaagugguuccugcugucaucuccucccuuacuuccuaggaagugguuccugcugucaucuccucccuuacuuccuaggaagugguuccugcugucaucuccucacuuccuaggaagugguuccugaugucaucuccucacuuccuaggaagugguuccugcugucaucuccucacuuccuaggaagugguuccugcugucaucuccucccuuacguccuagcacguaguguggguggugcuugagcucugauguugccccucaguuggccuguugugguccugauguuguuuuccuguguggcgaugcaguuaugacaggcaucuguuuugguaggcauuaccuccuccugucucauccaugcuaccugugggaugccuggcauucccccaucccagcccuuaccugaguaccuuaggugguacuugggagaguccugugcuagaaggucauggugcugaggucccuuugggauucccuugucauucuauuaacccacuagcaaaaguggaauccugggugugggaccaaucacaagauguccucauggagaaggaacagcgcuuauuauauacucaaacucauuuuugccaucuuacucaucuccucaaaauugugucuacugugacccagaaagcagguuaugcuggggccuuucauucaggaaccuugccugcccucuucagcuugccagccugcaccucuaaucccugaccccuagggggacugagacuuucugagucucuguccuggaacucacuuuguagaccaggcuggugucgaacucagaaauccaccugccucugccucccgagugcugggauuaaaggcgugcgccaccaccacccggcuaaaagauuucuuuuuugaggauuuaauuuaaguugguggcagaaguagguagauaugugaguuugaguuuagccuugucuucauagugaguuccaggacagccaggguuauauagggagauacuucucaaaaaaaguauuuauguguauguguguuaucugcgugugcaaguccaguagaggccagaagaggguaucaaauucccuggaauagaaguuacagaguuacagacaguuguuagcuaccauguagaugcuaggaauagaacucagacccucugcaauaacagcaggugcguuuaacugcuaagcuuucuuuccagcccucccucccauaaggguuuauuuuaaaagaucacuaaagggcuggagagauggcucagugguuaagagcacugacugaguucaauuucuaucaaccauaugguggcucacacucagagggaaugggaucugaugcccucuucuaguguguuugaagaaagcaacagagcacucacauacauuaaaaaaaaaaaaauuauggagccaggcaugguggcacacgccuuuaaucccagcacuugggaggcagaggcaggcggauuucugaguucaaggccagccagggcuacacagagaaacccugucucaaaaaaaaaaaaaaaaaaaaaaaacccaacaacaacaaaaaaaaaaaccaaaaaucacuaaugcuuaaugaauauauuuuuggcugagcauuuaacuguauaguaaaagaaagguuacuguggcuuuuauuuuaacugcccucagaugcuguuuucagaaugguuuucaaaguuaaagcgaguuuuaucuauccacguauaaguaccuccuauucucccgagauuaguaaugacaauuuuaauuguuguuuacugcuuuugugugcuugugagcaugaccaugcacgugugugccagaguuugugugugcaaauccucuuuguguaguuccuucucuuugguguaauuccucaucgcauccuaguuguguaugagugucaaacccagcaguuugcucucuucgguuugguucuguccccacacccuccuuaacuuucacaccugauuuguuguuguuguuguuguuuuguggguuuuuuguuuuuguuuguuugggguuuuuuuuuuuuuugaguguuugucaggaaauggaaaagauauuaagugauuuuuuuuucccugccugaggcaggcaaggcuaguugggcagcuagccuuggcacagggcaucagugucuuuaagaucucuagaaugcuuagcugcuugcuucaugguacuuuuagaucacaaagcuacuuggcucuuuggcaguacuccuguuaccagccuuguggcaugcagcuuuagcauuggggcaguacagguuggccauugccuuaagggauccugugagcauuggguagacucacuugaaguggcuacuuuuucuuugggcaacuugauaccucaagccugguuguugagagauuauugaauuucaaacucuauacucugguuagguguguaagcacugggcugcuacacuccugucuuugcuccacagagcaccugaggcccuugggaguagaagagccaugauaccuagcuauacauaguagcuuuccuacccucagcugcacugcuguccugugagcacagagugggcaccuggagcuuccacguaaguucugugccucucuugaguaguuaggggaggagggacaagucucagaagugggaucugagugaaaacugacuuaguauugccgcacacaguggcaaggcacagacugggauggagcagguagaagcagguaguuggcaucucuggaucuggugggaggaggcucaaucuucaaggccgauacuuuggggcagcauguuggcagugccaugccauauggauauucucuugaugugucaguugucugagguguuccacauuuagaaaaacucaguuguaggcaaaggugguugcuggagcagugagggaccaguccaguggggauggacuaaugaaucacagcuacagaugcccugagucauuagaaacuguccagagcaucuguucuguuuggcuuagaagcuaguuagugucuauagauaguauccuaaggaccuuguaccggagacaucugaagcucccuuucucccuuucucacuucccugacucuguuucccauuccuucugguaacuuucuguccuuaaaguagauucugagaggucucucucagugccuggagagacacagggacugcucagaugauaagcuuggacuggacagaugaggucuggcuaucugggugugcaacccgugcagucuccaugaaaauacuccuuaacuccgccugcagacaugcuccuugaccucagcgacuugcuccagguagaucacucuccuccuuaagucuuuccugaccugagggcauuguagaggcauagcuguguuuccauacaccaggaagucagucuaugcugccugccauaguaggcagccuuuguguucagggugaugaauuuuguguggccagagcaugggaccucagcagaagagggcagcuuagaggcacagcauuauccaaggacugaugucucagcuuuaaaacugcuugagaaacucuugugaaacuuaguccaaggucaagcaaaucuuuuaaaaggggaauauuggacccaggcgugcauuuccaacuguggaaaacccucgcaagcaccgccuguuuagggucauugccuuucuggauccagauacaguagguuguuguugcauugcuugucuguguuuguuuaauaccaggucucaaguagcccugguuggccaggaaugaagagauaugccugccuccgaagugcugggauuaagugaccauugcaccacucacuucuaaauaacugaguaucauagcaagcugcagcuagggaccuccaaaggcagugaaggagagaggggcaucaagagugcacugucaucccacugauggagcugugcuagagggcuggguagagacuuacugaagucacugggccacacccugaguuguggcaaggcugugagguccacacugacacuguggaguaugaauagaaugccugcaagcuuugcccugaagggaaauccugaucugggugccugccugccugccagggauccugagagccgauaggccagauuauugcuccuguuugcuuaugcaucagugcccacaaagagacuaacauuuagauuccagucagagggugccuuguauuuuuguccuuucagcugucuuucuuuauaaauggcaucucucagcagcuauuaccgaaacauauuuuuugucaaucuaaaaauagccugcuggaauugugaucauccauugacuccaucuuugaauguguugugcucaguucagagcauggucacaugacuauauccagccucccaggaaagaugggggccagggccaggcagcuccagaaguagcuuggacaccucuuugaggaaaccagaggugcacaagucagcuuugacuucacagcuuuggaaaugggaaaacaguccagcuugucagaauagaagauggcaugccaccaggaagggcugagggcuggguagcugggugacuacagacuacucuucuugguaugucucuacugacaaaauggggucugagggagacugaggugaggaccauacaagguugucccaucccggagcauccacagcauguugucccuggugccaggccuugccugaccuaaagacaguuuugcucuuaccuguguggggugcauacccauguccaugaagaccucuaauggggcuggcuggcugcuuugaagaaauacgugaaaguagaaguggcaaagacccuguauauaaagccucccuccuuccugguuccacauauacagcucauucacaagcagagugaauuguaauguggcagugucuaauaguaauauuaguaugccuggaagccagguguuguguacacaaagcccucucuagaaaguauucaaauuauuuuguuuuagauuuauuuguaugaacauuugcugacauguaugugugugggccuccugugggccugguacccauagaggcgagaagaggguguuggacccucuggaacugacuggaguuagagaugguugugagccaccaugugggugcuggguuucugcaugagaaacaaguguucuuuaccauugagccaucucucuaaccccuggaaaguguuguuaaaacuuuuuaaauuuacaccugaagucuauuuagagaacucuuucuguaguguucaggucucauugucaaccaugucuauugguaccuggguaucuggaggaaccugagaggaugcucgggaagagugcucccacaggagcacacuuacuugcauaccugaacacaggcugcauaccacaugcuuacaucaacaucacacauuccugcauguuuaugucauauacucacauaggcuauauagucaugcacaccauaguuuuguagacaacccuugagacuuuaggaagauaaagaauuacuucaaaaagugcucugugagccacuaguccuugugaagaccucaggaagauaguaccuguguccagccaggguagaaggugaccaacccagugcugauuggcuaugguggcuaaaccuggccuucucagcuggguugacuuacuaagcaggcaaacucuccccuuucguccuguauguaagcgaagacaccauuguguaucauccuuuagacugugucuugcaaacauuuacugguuaucaccuucaugccaggaaagggggcuuagcaacggcccccaggcuaggcuugaucagguaaggaacuucuuucaggaggccagaggcagaaggcuagaccaaccauaucuguaaggcccaggagucccaggaguggucucgcaugagugcagugggguuuucagguagcugaggaugggaaggaccucugaggguggggcaggccugagugucccagguuaauguauuacaguauuauacugagcuacaacugcaugguagggguucuacacacuggcaaaccguugcuucccugacaacugauagcgcuacucccauuccaacacuugguccaucccuccuaggauggacuuaguucuacugcuuacuccuguggcagagaagaaagagcuauggcagguggcccaagcugggcggcaggcuucauggcagauaaggacuugaggugaggguauuggaggaaacaguugggauuccagcuacugcauuaccuaccauacucuaauguguacccacaacuuuucuaagcaaccguugaaaaagaguaggggagucugggcagcccuauaggaaggaggugggcccuccggguguagaggccaguagaggcaugguguggacuuuuccuagccaagcaggggucucuggcaauggguucuuugaagacugaacaaugaaacagucauuuuaagaaaacagcagcugagcuggugugguggugaucgccuuaaccagcauucaggagguagaggccagccugauuccagggcagccaggacuacacagagaaacccugucucaaaaaaacccaacaaauuauuuuaaaaaggaaggaaaaaaagcagcaaauguuuucuugaacaccgauuccugucuucuucuugcccuagguuaacguguauguguuggggaagacguuccugcucuuggcgagggagcuuugcaucaacgcaccagcuauagguagguugggcucagauaggaaacuaaccagccaaagaucucagaguaggaggaugucaggucaaaguauuagacaccaaagguuaaaaaagucuccuaaaauuugugguaaauauagccaguagggcguuauuguacaaacucagaaggccuaccagugccugucaaaugacggccaggacacaaagagaaagaguacagugcuucauguugggaaucuguacuguuugaagcagguaccgugagaaaggcaggggucuucucacaacugagggacgcuccaagaacagaugccgucuagccaugguccuugccaugugcaaagauggggauuuuaugguuucugaagcaucaacucauguagaaguaccacgugaggccacagcagagggucccaacagggccaagccucugcuguuaggcacacugggcuaaggcacaugcucuugccccagagaccacugcccugcuaguggcccacagcaagcaggcagcagagcacauagcccacucuuaaaaucuaacccugcaauagagcgugaggugccaccuucugcagaguucugcagccuuugagagaagccagcccaggagccgcaggcaucuugggauagaugacuucccuaagacaugguuugauuccaacagcuuuacacugcagacucucagacaagacggucuucucaguggaauugagaaagagagugccccacuuaauuccuacagucacuuaucuacauuugguucuuguucugugaaaccuuuauuacgaaaauucacuuaaauaggauggaacuauuuuaagugacuuuucagcaauuuguggcuugaaugggaggccucaacguaggcugaaaucacuuagaauccaaagggggagggaaauccaaggguccugaagcuugggugucacuggcagggaucggggacgaccuuggacccaagucuuccuuccaccuguggaaugcugucuagggucagcggacacgggcugugagaagucaaguuucagacucuggcugauagagaaagccaagccuugaaugguaucaguaaggcagcuggaaguguccugcaccuccacugcacuuacuguguggacucuauggaggaagagccugguggcaaguccacuccaaccuuacgccucaggcauagaagaugagcucuggaaucuguccacccugaacuccagucccauugguacugucugaggagcacuggaacuggaaggcuaccuucccacacugcaccucugucauuccuucuugcccaaaguagcugagcucacugccguccaggacagcacuggcaguguagaagguguccugcuccaccuggaccgggugcucaaaccagacugggaaaguguugcuggauccgucugaaacaaacuuggugagguucugagccaggaccaucccuagccgcuugaguucaaucuugacgcuguacucagccuucccagagcuggacccauacaagcccagcccagcaaugaacacccuucuguccacugcaaacuggaugcugucacagcguccacgguaccuccacugguuacuucgguaggcagaagacuggaagcgguggcaccuuuguggagcaaggcccuuccucuuggucagggggaagucaaggaggggcuuuuuggcagcaguguaccaaaggaagauguugugggucucuucuaaggucaggaugucugacugggcggcaccauuggcaaacuccucuaaggucauaguuggaauucggaccagguagagggcucuucccaaaacaugccucuuguugugaggagugacugggaggcccugucucuuacauucugccucagcccaguucaggacggccucgaagaccacagccuccuugguauugagggccucccuggucacaaugaucuccagugucugccggucaauuucacagaagccuucagaccucagggccauuucagcuugugcaucaaugacuucccagcaucucugggucaguucaggcuccucaaacagucggcucugggacagcaggacacaagcauuuuuggcuuccagacuuguuuccagaaaguugacgcaggccuuggccagggcaggcacgauguacuucuuagcagcauacagaguggcaagcacuguguccgccuccaggucgaucucaucgcuguacauguaccugcguaaggcaggggcucuccuggggagcugcaagggcuccccugcacaaccucugggguuguagcaaacagguaggggaccauuggaagguaaccaccccauccuuccagacccagcgcacagcacuuacuuuagcaagaccaagaaggcagcaggcuccacaucgggaauguggauuucugacuucacuuccgcaagauccccguagaacauggcauagaagacggagcugccgacagccaagacauacuguggaugaaagaaaaccaccugagcuacagggcaguaaacaagguccagggagacgcaccuagccaggcccaccaggggacagggcugcgcccuuacccaccuugugggcgggcacacgccuggcagcccccagagcccccacgaugaaguggacgucagccaucagcucguuguugaacaugagcgcauuccugcaaagggcagaggcacacgggcuggaacggcgcgcgcccgggcuccagagcccgggggcgggcggcggcucaccucucgcgcagcguaggauggaaggacugccaguuggggcucucgggauuguuguugucuggcaagggcggcgcgggcaagggcggcagcggggcgggugccaggcagggcgggcagcaaagcccgaccuucgugcucucggcugcgccugccgcguugcuguuggcgaugucgguggcaguagcugcagagggacuggcgggcggguacaguuccgcggccaucuucgcuacugccggggcgggcuccgcacuggucggugcugcgccgcgcgccuucgcgccgcgacggggccugggaaacggcucugcgagcaccagcagggagguuaggcacugcgccacccgcccaugcaggcaggcgagcggcagcagcauggggccacgccggcccugcccgcuacccacccgcaccccacaccccucaccgagcccgcggcucggccgcagggggcgccgucccgcccguacccacugcugcggcgccggcgucucucgucacugugcgucaagacgcgacuccucguuccagggccccgccccugggggagguguugaagcuccgcccgggugcccagguuuaagggcgaguugugguugcaccuucuaucacucagaaaugagauuuuuuuuccaacagcucaggcuuugaaaaaucaccugacccagcuagcuuuucuucguggaggaaaugagucucuaacgcaaggcuugaucucccuuuuuguguacagcuucuuuaacagagcacaaagucaagggcaguacaccuguuaugucggaauuucuuuuucugucaugagucuagaccucaugugccacagggugaccucaaacuuucuacauagaccuuccuuucuaaguugacuacuccaauggguuacauuuuguuugccaguuuauccaaccguguauauaucaacucuauaucccaguugugcugaccauagggaggcaauuuuauccuuuccagauccuaauugcaauucuuugggucuuuauccagaagugagaugauuggauaaaaugguagcucuugauuucucauuuuuauuuuauggauguggauguuuugccuguaccugguguuugcaaaggccaggagaggcuguuggaucuccuaagacuagagauacagaugguugugagcugugagcuguggguagaugggugcuggcucuucagcaagagcaauaaccacucuuaagcacugagucauauccagugcuucgugcuccccccgccccuuagguuuugagacagggauuuucuguguagcgcugacuguccuggagcuagccucagaucugccugccugccuccugagugcaccaucacuguccagauacaguuacuuguuugagcaaacuuugcaauggccuuuguucgugcuuguauuauuuaucaguccuccacagcgugcacugcucuuuucccucauccuggguaaaccuuguuauaauguucuggguuuuauagaggcuaugcuaguggauaugagguggaaucuugauugcugaugucaaccuuucuguguuucuuggucauuuguauaucuucuuggaagaaguaccuccaugagucguuugcccacuuuccaaucagucugcuucuucacugcauugagcucagucuuuaggacagaugcuuucucccuuuuuugugguugucuugacuggacagacuccuuugcugcauugauucuuugcagucugaaguuacuauguuugucuguuuuugcuuguguuaaaucauugcucuguguucuccaugguuuugcuauugguggugguuguuguuaucuuuuuaauguguacaccuuuggucuguuugggcagaguacuacaugugacaguaaacuuuguuuccagccuguuugcugaagagacugcccuuacaucuuguguccuccccgcccccuuuauuuguuugcuuuuuuugagacggggucucgaugugcagcccugacuguccuggagcucucuauguagaccaggcuggccuugaauuccuagagauccacgugccucugccuccugggugcugggauuacaagcaugagucaucaggcccgucuugguuucuuuguucuuuaauacacgugccaucuucauaacuuccacagaccgugcaaaaggauuacuuugugagacagagaauuuaaagucuauuuaguaaauguagucugcugacguguauccaccuuaguccuuuccccagacgucaucuucuucccuuccuuugguuuagacauuucuguuuccaguguccuugcauugcaugacugcagcucuguccccaugugcagacagacuccacuacuuaaagaagauaaaguaggcugcuucaggaccuccaucuucucugcucauuuaaccccaccccgaaguccuucuguaguguuuugcuuuuguaagauguggggucuaucugugcucucuaggcuggccucagauuccagaacccgaggguccucccuacccaucuucccagucacaaggcagagucucagcguuuuucucuugagucugugugagcuggaguggguccuugucuauguggucggucucauggauucccuuuguagaagucaguuagccuggaaggagggcuggggaccagucagcagcugaccuccauuucuuucccuuccugcugucuggaaagacaaguuagacggauugauuccuucucccagcuucuccaagaggcugagccaccccagccccuccucuguuguuauugccagugcucuccaagcugccugcuucucagaccugagcagaaguggcucuuccuacacaaguccugagaucuccucugucccuaaccaguggcuucugucagagcacuaauggcaggguaaugaacugaaugaugaagugacuugguuguucuugcuggcuccauuugugagcuccaugaaccuuugacugaacuuucgguacucagcagcgugccaggcacuaagaagaaacaacugugaacgcgcacgugcaccuguaugcccacugugcucauuuuguaagaugcugaucugacaacggccaggacauugagggaauucagggugcugcgugagaagagcccauaccuggccuguucuccagccucucaucacccucugagagaaggugggaguuguccccucaccuuuugccauacaugcccagaacugugccguguggaggcagcaguuccccaggaccaguaagcacagcugagggucagagacugugcuuuagggaggggaccucagggagacguggguaaagccacccagcugcagggcacugcuuagugcucugugugcacaaaugcauaugcacugucuuagguucuguguuauguuuacuguguagacccaugcuuguacauuccacgcuuugcucaucugcuggaguuuggggagaagaaccaugaaguauccaugacagccuugaggcuucugcagagaaugaaaagggauuggaugcacacgggccggcgccccuccggccucuguggagcagguacaguguaggccauauggcccuuggguagcguuuucuguccugauacuugauaaguucacacgugugugggaggguaauugcagccaaauuuaguuaggacccugugcauaguagguaaauugaacuuuagucaucugucuugagccuuuaagccgucaagccaaugaguuauugguugcaguuccagagucuaccuuauauaagagcugugucuuagaccccaggacuggccuggccuucuuuacuccuuaaggacucuggcauuuccucccuuguuggcuucuacagguucuaagauaaaacaccucaggggguaagauaacagugguagcccuaguuccaccccaggcuguccacucauggcaaguugccucuuucagcaugguuaguaauauggccucucauugagauacggagccuuugcuagcccagcagcauagcuguuccgguuguaucuguaaggaccuggugcaggugcuugguggccaagauuaaagaguccccuacccagggagagccccagaucagcaggggccuccucuuuuguaguauccaucuuccuaucucucugcagagccugguaccacuucugcacucagccggugguagggugaugcuaucccagacugcuugcaucugaaaccaauuuccacauuuacacugcagacucuaggcuccuucacucacaugaccauaauucacacuugucacacaggaucuuuggacagcguuucccagcuuuacuauagucuuggcauccucugcuccaucauaaccaggagguuuuguguauuaacacagcucaaaguuaauucaugugcuuugagguguuuuaagaaauucuugaguuuccuguuuuaguuucccuuguuuaaauguggaguauaguauaggcucaacccaaaauaagaagaggacuaccauugcccaagacugugugcaccauaggucuauuuagggaaggcacacagacacgcuguccccuuauagaagccacagcagacacauccugcacauacuuguucagcugucacuagccaagguuaaggcagaauuuugcuugcuuucauuucuauaugaguucucugaugaucuuucuuguuucuuuccuagcacuuuugguugcagccagaaugcaugacuuccggagaacggucaaagaagucaucaguguggucaaaguaugugaguccacacuacggaagaggugagcauucugguucacagugauggccacugccagcuuguauguuguagcuacuucugcccuggguuaccccgcccuuuggaaguacuuggcuuccuaccacagugccucuugaguuuaguagauuauuagguauacagguucccccucacagacuggaaccaggcagagaagcugcuuugggacagcucgggaggccaccuaucccauuugguaugguucauucugggcuugaagguccaagugacuucuugcuagaguugguuaaaccuccccaugucucucaugggccacgggcucuguguccaacuuugaacaaguuguucccaucucggauaagcuuugcgcuguaaccaugcugaggacuugcugagauccacugcuguccuugcugauguguaucacaggauuaacacccgaugaccauuucugcugacaggauugccucaguaccuucuagaagcaaucggaaaauuguauuuugcaucuaguaucuuuaaaaguacuuucaaaaguuucuguuacauuuauuuuuuuacauguauguaugcacauguacacacaugcaacagugcacacauguagagaucagaggaugguaggauggagaucaggucguuccuucugcucugcaguccucagaucuucaggcuuggcagcagguuccuuuacauugcuaagccagucccauaaacuccucuuuaagguguucuuuucugagauagacuacuuuauguaguccuggccaaccuagaacuugcuuuauagaugaggcugcccuugaacucacagagauccuccugacuuugccucccaagugcugggauuaaagacuuguguuaccacacagucucucucuuuuuuuuuuaauuuuguuuauuuguauuuuaugugcauugguguuuugacugaacauaugucugugugagggugucagaacccuggaacuggaguuacaggcauuuaugagcugucauguggcucuaagcauugaacucaggucuucuggaagagcagccaaugcucuuaacuauuaagccaucucucuagcccuucuuuuuuuuguuuuuguuuuuaauuaauguauuuaaaaaaauauagugugcaaguuugcaugugguggucaaaagacaaccugccagaauugcuuucccuuucacuaacuauguaggugccaggauucaggugccacuaacucaggugucagguguuagcuaauacccuuacuugcugauccaucuuguuaaacuuaaauuuuuauuauuuuauuaaaaaugguagccaagccgggcgugguggugcacgccuuuaaucccagcacuugggaggcagaggcaggcggauuucugaguucgaggccagccuggucuacagagcgagucccaggacagccaggaccacacagagaaacccugucucguaaaaccaaaaaaaaaaaaaaaaaaaaaaaaagguagccaagcacuuuuguaacuccagcuguaggcauuucaaggcaggaggauggagccuugaagucaugcucagcuacauaguaacuucaaagccagcccugcgacaugagacugugaagaagacccaaagccagacaugcuauccacuagugugugcucacacucagcgugagugugacgguggaggccugcggauggagaguccaaggcuagcccaucaaaguagcucacucagcagguccaaaccugacagcccgaguucagucugcaggaccacauggagaaggagcuacaaguugucaucugaccgcugcugugcuuuguagcacgcaugagugcguauaagagcacugcacccccccccauaagugcacuaaauuuuuuaaaauaaaacacaggaaaguugacaagauuuaaaugguguuggcugccaccgaggugccugccuacucagguuguugggcagguagagcugggcccucccuguagggucuccugacucuuccaccaggacccagcagugugcagugugcagugugcagugugcagggaggcgccauggcucuucugcuucucugucuuaggcucacagaauuugaagacacuccaaccagucagcucacuauugaugaguuuaugaagauugacuuggaggaagagugcgacccucccucguacacagcuggccagaggaagcuucgcaugaagcagguggcugcgaaacucccauuagcacgcugguguucugggaguguuugcucucuaacauccucacgucuguugagcucuccugcuaacuugcucuucuuugggccuugagucuucggggaugugcugcauguggaaccuccaaguacuguccacguggaggcucauggcgagcuuuccaucccgggcccauugagccauccccacagccaggcuugcuuccuggcuuguuccuuaucaucugaggcagcugccacugcugccagccuuucugucagcgucacugagcuugugacuuggcugucauggggacuguacucgagggagggcagagggccagaggugggcugcagcugaguuuuggagacuucaggagguacauucugcagauaggacaaaccuggcccugcccagucaaguuggcuugguugggagguuuaguuuuuaaguugauggguguuuagcaaggcugcuucugucuggggcaacaugcauguuguuuggaaggagagggccaggccuacaacucgauucugaugagcucugccaucccacaaccuugucaaaaaugagacauugugcauuugacuccuuacccaagacucuuuugucuuucagcuggaacagguccuaucaaaaaagcuagaagaaguugaagguaauuaaccgcuucucacacccgugcuuccuuuuugcuuggacaucagugugcuuacuuuuugcuuuuaacgucuuacucuaggugaaauauccaguuaccaggaugccauugaaauugagcuagaaaacagucgaccaaaagcaaaaggggcucuggccaacuugucaaaggauggugaguuccccugccauuaugggccaugagggcccuagaccagcaccccugacauucccuacucacugauccaugaccccaucccuggcugcuugucacucccuacacuggagcacuaacuuggguaucauguuacugcugggacgccuucccccgccucaccguucacuggccguagaagagcuucaaccuugcaugugccguacugggagcccugcuguccacucagacuguugaagaugcaaggccacgacuguagggaugcucuuucuuaugcccugugcuguuugcugugggcuuuucagaguugcuguaaccguuuguguuguuagaugacucuccucugggcugugcagaaugaaaaagcaugggugccugcuuccuucuuuggcaccuguucuggggaagcuacucugggcaucucugcccaucagacuggcacugugcuaacaucuugagacaugccaagcaagugugaauguccuuuuugggaucccucaguguuugcagaugcuugcuuauguucuguguccacauuaggaucaccuugucuacaccacuccagcccagucugccuuacuugucagcuugggggaagcuguggcacuugucuuucuguccuucucuagcuucuguucuguccaggcuuugcuccugugcaguaccacgcugcugccuuccguggggcuguugugaguagcaucuuucccccuuugguccccacagcaacuugcagcuuguguccugacugcuccugcgcagugugagcucuccugccaccuguaguaguugcagucauuuugccauugaguuuucuaaguauuugauucugucgucugcaaacagugacucugcugcucuuaauuucuucuuaagucugccugaccccgcagcaucuuggugaucuugggacaguaguauauccucauguuagcucccauggacuagggugcacgugcugggcacauuguucccucaucugucauggugagucaacgcccacccaugcauugcugucaagagggguuuuuuuuugcuugcguuuuuuuaaucucuguggauaugaggguuugagagggccaugguaucuguggagauccugugaugggugaauaugacccaguguccugacugucacaccauuggguucucccucauuccugaaggcaucauuugggccucaauagcugcccuacucauuccuauccaggguuugguucugucuguuugcagaguuguuugccacuugugguuucucuguguagugguuuucucuuguccuagcuuauugaugauugggcgagcauccuguacaugcccagucugcugccuuguguuuaccaggccucacuucugccaggcuucauccuuccaaucuuauuccaccuuccaggccuccugccugccuucucuguucucagucugcuggcugcgugcauuuggggcagugaacuuccugugagaucuguccuguuggcgguuuuuuagucuccagauauuuccucucuugcacaugugagggagcuauggaaguucuggggcuguguugugagcugguuacuaacugcuguggugccgugcagugaccaggaccuguuacugauuuguuccuccucgguauuucuugggcacacaauaucauccauggacacugcagaggggcaccuuguguuaugggcacagaggugaggcugucccacugucaguuuugauagauauugagaaccugucacauaguggcuccuucagaguuuggucgccccuuacuuccuccaguggccccucauacacauacaaggccauugccuuguuaugauuuccaaggcucaucuuccacaggaggcacuuugccacccucaugccugaagcccuuggggcacacguagacccagguguuacuaagucucuguccuucucuuucacuuuauguucaccugggagacuucuccaauacaacagacaccauguuucgugucuugauccgaucugaagcauccuucuuccuuuaguggucugaagcaagcuugucuacuuacuaagccuuuuuaguagaguucucuuggucuuagcugucugugcuaauguccuuuguguaguuuccucuuuuucuugaacuuuaucugugucccucuuccacacaucauggcuuuggagcacagcagaaaacaacuagcuggauauucuagguccacuucuacagcuggggacagagaugugccuuucagaucaaacacuagaaggcacugugugcacgcugcaggcuguauggagacagagcuaaagcaccuuuggcuucugaguguugacuguggacaacccuggugucaggugaggccagcaccacagucacuguguucugccacugagauuugucccugccacuaucuuuguguccuuuguaauggcauccaccuguucuccccacuucaggcugccacuggcugcuuucugucacugaauucguggucuuuuauauacuuuugugcagaaaucuuuuguagacauaguguguucccuugccuuuccuuggcaugauuuuuaugcaguucauuggcagcaugacccucuguauuggguagguguuguuagugcggugaggaguguggcacuccuguuaagugcaucugcaucagucccagguagcccuauguacgggcucaucccauacuuacuuccuugguacugggcagauggaauuguugggucugguggaggugguguuggcaaauagucugaacagcacugucagcauuuaugcagccagccccccuguuuucucuccuuccuuucuguuuuucugugucuagacuguccuuucagacauuaccuguaaauaaacuauggcucaccuuugucuuacaaugucuuucacagggcaggcuuguaauucucuuguaaaaaaaucaugauucuuucaaaaaucuauuuaucuguguuuuauggguuguguuuuaguguuguugagguauuuugccuaacccuagaucacaaacauuuuauuugucuuuccugaauauucuuagacucucagauaccacauuuaagccaguuuugcacagagcaugaggaauaagccagguuauucuugcacguggauaaccggcaccauuugcaucaggacuguacuuucucugcugcagaaaaggcaugcuugggguaguuuuuguguucuucuuuauuugcagcuuugcaaaaauguuucuguuacaaaaguggguucucucuggcuuugugccugguugacagguggugugcgaaucgugugucccuaggcuccggugaggacgccacauccaguccacgcugugaggaagacacugaggaugaggagcuggaggcugcugccagccacaugaacaaggacuucuaccgagagcuccucggggacgaugacggcucggaggcagcaggagacccugaugggggcagcagaccccucgcccuggagucccuacuugguccccugcccacagcagccagccugggcaucuccgacuccauccgagagugcaucuccuccccaaguggggaccccagugagugcccugggacaagggaaguuuacagucugaauugucccugcuguggauuggucagaaguucacgggcgggggugaggcacugccaggcacuguacaguagucaauggccugggugcccuaguuucaguugugcugugagaagugcucuaucaaaggcagcuguggggaacacucugguccaucguuucagagaagccaaggcaaaacucaaaacaacuaaaaucacucacauccacagacuguggcaaaugggaaagaaacacuucauugccugcuugcuccuguguagcuccguccugucuuaccuaguuuaugaccgacucccugccuagggaaaggugcuaccacagugaucugggucuuucuguaucaguuaguauucaagguagcaccucuuagacuugcccucaggcaaaccugauaaagguguuuauuccguugagauauuuacccuuugcagaugauuguaaauuguagcaaguuaaugucuaaaagucacauugcacaggguaaagagcugggugugcagcaguguacugagaugcuggcuggccuguuaccaucguaagcucucucuaguccaguugaacuucaggggacaccaaaugacuaagagagggucuggcauagccugcaguccugcaggugaggggagcaggcaucccuaauccuucccuguugcugggcugggcaauccugggccaaggugcaucaucaugggcaguaucaccugcugagcuugaagaugggcagaggggaaccaugaagaucaacaauugccccugccacccaguaaugccagagcucuauagcuucaugcccuucacccuuaaaacacugggaggggcuggggcaaugacucugagguuaagaaacugacuguccucuuucagaagaccagcacccacauggugggucuaguuccagaccugaugcucucuucuugugucuggaggcacugcauacaugugugguacaggcauacauguaggcagaacacccauauacacaaaauuaaauaaauaaacaaaucagucauuuuaaagaagggcugggacaccaauggaaaggaaaguggucccaucccuguaaaguggcucugccccgugaccaggugaggauuuggccucucuagaggguggagccucucauauggguggaacauugaaaguugggggccuauguaaagguuaaaccucucagccgggaggcaggaugcuuucuuuaccugugggccaaguacauagaggacaguuggguaucugccuuugagggagcaguacaaagggacuugguaaucugagcauaggcagccagcgcagagagcaagggaaguggggccgacuucagagagaccuagccuugacccuaagcauccccacagugagcaguaucugcuaggauagccucugcgaugcuugauugcagcgucugcuauggcagccucggugacacugauugggguucuucucucuagaagacucuucaggggacggggagcuggaccucaguggcaucgaugaccuugagauugacagaguaaguaagccugggcucccuuguccccagugguaguugggacuuagggggacuaaagugugucuggacucaagcuuuaggcccguuuagccucucugagccuugugcucccuuagacaucccuaacaaaugagugcucucaaggcauagugccuguaguacagauguccacuggacuucccccuccaaacuccauuccaguguagccucagcgucaugugaccuuccuccugaaaccccaagcaccccaccaggaccauguuggaaaggccccgaguucugaccuggccuugguucccauuguaucacaaguaugcuguucaucucuauccccaaaucucaggggucccagacuauacacuaacaccugccuaacaaggccuaggaacugucaguacucucucacggcugcagaguuaaguuggcagagagggacaaaggacucacagguuucuuugcugaaggaggccuccccacauccuuucuuuggcaguuuaaguguauaaauaggaagcuaguuacugagaaauacuugaaauacuugagagcucaaccuuagagagcugaagucacuuuacugugcuucccacaguacaucuugaaugagucagaagcccgaguaaaagcugaguuguggaugcgggagaaugcugaguaccugcgggagcagaaggguaaguaccgucuauccaccugcccaggucccaggccaugucccuugcugaggccagccauuuuguucaccuuacagagaaagaagcaagaauagcgaaggagaaggagcuuggcaucuauaaggagcacaaggugaguuucuccugacggucuaacucagccuucgugucaacugaugggagcaaagaacuuugggaacaccucuccccuguguccauaggagccugccugggacaggcaguggaagccauagaacacacaucccugacagccagguuguuauguugcaagcuccuucaagauggcuugugccacccagcuuuggagugagguauccagcacagguguuaaggcagacggaacugagaugcagggcugggcucggguccugugcuuggguuucuuguugaacacacagaagccccuaucuucgugcuuauguucuuuaauaacaggcaaguacucuugguaacuugacucccucugggguuucagccuccugguguuaucuuaggaaggggcugaaccuuucagaagccaaagagaagaagauaugaugcuggcaaagcuuguuggguccaggauggaggcccagagaauaaguggugucugcagggaagugggucccaaaacuccaugcgaccaggcaucguggucuaugcuaugugagacacuuuccuuuccucuccacaugaaaggcuuagcuggaaagguagauacacagaaagugagguuagcaggugccguggcugguugcugccaaggugaccaaacuaguuucugucccccucaaugggucacagcuguggcucaagaguagauggcaguugugacgcuagcaugugucaggaggaguuacuuuuguguuucauucagcccaagaagucuugcaaacgccgggagccaauccuggccagcacagcuggggaggcuauugagaagaugcuggaacagaagaaaaucuccagcaagaucaacuacagugugcugcgggaccuuaacagcaaggguggaggcagcccacccagggacgacucacagcccccagagcgugccagcaccaagaagcugucacggaggaaaagagcaacuaccagaaauagugcugauccugggacaagcacagggaagagguacuauccugcuucuuggacuaggugucugccuggucaacacuaggcucccaucugggcuguugcuucccagccagagcuucaggagccaugcuuggcccacugugugcugaaugcuaacaagccaucuccagaugugggugugucuugauuccuccaaacccccacuucugggccccagaguuacaaggcuuuuggcagcugugggaccuacuccaucuccagaaagcacuuggacacucaguggaaaugggcucuuccauuggcucugcugggagggaggaagcugccacggugaccccucugguggggacaggaaaccagucacaagccugcauaggccagccucaucgugcugggucaguguugcucugcagcgugacaaggggauguuugggguuguucggcugugugugguccuccguaugacuuacucuuagguggcagcugccagcuuuccugaugaggucccaagagaguucuuaggcuggacacccagccugaggccacuguaaggugccucuaggccaugucucagucccucugugguucucucuuccguaccacacugagcugaagcugcuucugugcuuucucccagguugaggccucugcugucugcccagccggcgaagaaggcagccgugggagagguauguugucccacacagccaggccggggccucaggaucacaggcugccaucaggcuuggcagggagaggcccagcugguugcugcugcaaugcuggcugggcuccaggagagaauccugaagcccggagagugagggcuucuggaucacaaaaguggagcaggcaggugguaaaggccaguuauaugcuguuauucugggacugagggugagcuaaucuccacuguggacuagagugggcgaaggcuagauuccauaccacaguugauaacuuuggaaaaaggagggcugggacuucuuagcccagcucagaugugggucaggaacaggaacugugaggggugcccaugcccagacugagaggaccugaggaucccuuagagucaggaggauugccacccucugcucucauuccggagcccugcccucucucucuuccaggccuuacucuuaaguucuccugccuugggagcagagccaaucaagccaucagcagucuugguagagaguggcccugugucguaccauccugaggaggaugcagaugaggaggacgccgaggacgaggauggagagcccugcgucagugcucugcagaugauggguggcaaugguggguagggccacaugguugugggcacaguagaggaacuuuugaagggauauccagagacaaaaagacauagccauuuaccugaguaguuuccaaauaugaccccuauuggcuacaaacuaaguuucucucugcaaaagaaggaauuugaacuaggacaugaaaauuggccauauugauucugaggccccuuuuuuuccuuuuucuuucucucucucucucuuuuaaagauuuauuuauuauuauaucaaaguaaacuguagcugucuucagauaccagaagagggugucagaucucauuacagaugguugugagccaccaugugguugcugggauuugaacucaggaccuuuggaagauuagucagugcucuuaaccgcugagccaucucuccagcccuauucugaggcccuugaauaugcuaggagaaucaaggcaaagacuagggcccagcucacagagcaaugaggcaucugcagugaaucagggcaugcuuucugggcuuguugggagucagcaaggggcugcucagccaguagacagugagugucauggcuuagccauacuauuuguagugcccagcaaggagccaaggcugccccacagggcacacaccagucccccaucccugcaggcagcugggauagauugaaaugguguuuucaguugguggggucugugaggugagcaguggggauggggcugggagcugggccaggagaacauccacugcuguccuuuguuuugcagauuacggcugugauggugaugaagaugauggcuacugaguggaacucaaggccaggcagcguccuggugcuggacuccaaguguaucuguuuuaugggugucagaugggcccuggggccacggcucauaggaaugauuucugagacucuaccagucaagcacugccccacuuauuugaagcucucuuccuguggcuacauuguggaccauuguacuuacuauugggaaucauguuuugagcaauggaagggauauuuuugcccagcaagggaaacuagcuguguguuuauguguaaugaaacauggucagagaguagcugggucuggaucccacuucguggccuggccugcuagugacuguuuaccagcaauccccaggcaggcacuguguccuccugucguuaggaaauugaagcacaagggcuucagucaagaaguccagccagcuuagccugcugccaguguucucugcccuguccuucccauccuggagagagg

SEQ ID NO: 12498 - RNA, 12738 nt, Mus musculus
cagacagcucugaccucaugagacaagagccggcugacaaaacagaagggacccgaaagguaaugcuuuuaaauucuugcuucugagcucucuacacauuaaaagucaguauggcuaaaaggacuuuuacaacuuuuuggcaccuccauaggcauuguaaauuguaucauuuucuauugugcaggcagguuaauacuguuuuuuaauaguccuagagcaugcaaauagauuguguuuauacaacccacucagcacacauauacaaguacauaugccaaaaagaaaguuauuuuuaagaguuccauuugcaaacaguaaauccagggaacacacacauauucacauacagggagaauccaaacauugauaacuugcucuuauccaaaugcuacuauuaggacucuugaguuguuuagagucauuaaacuuuuagcucuauguuagucugucucguaaaacuuaacugcacuacaaaaugcuccgaguucuguaucuguaacuccaaauaggugggugacguuauuauaacacagagauguucuccugaaccauugugaugcaagugccccuacuucucuccauuuuuuuuaaaugaaaguuuuagguaauauggacagucuuaucaacaacagcagaguccuugguguuucuggagcugggaguccuccuaacccuacaaaggugucagagggcuuauaacugagaaagucuugugcauuguugcuuugggaaaagauagcauuugugugguucagaaaagcauugauaccugucaaaacugaaguuuaaccuagugucaugauuuuaucaacuucuuguauguagaucuuaugcuuguaguucugacaccuauuaaaucuguccuccugaccugcuuuacuucacuagaaugcucugaacauagaaggugucagacagaagggaauguaucuagugagacacuagaggguuuauauguagggaagaagcugggaaaggaggacuguuuuaacagaggacaccuuaaagauacuucugcacaauaaaagacagagaaugaaaagguggugggaagaauuuaaaaaaaaaaaaagaaagaaaaagaaagaaaagccucagaaagaaauuguuuuaaagugcacacuggucuuguucugugaauacuguaauccucaaugaacucagcucugcugguacuuugaggagaaaugacccagccaggcagcccugccguggaugcuacacuauggucaaggcugacaaggggaggugggcaaguagaagaacaaaaugagaguaguucaugccaggggaaaagaauuugccaauauauuuagagauucgugcccuccagaccaguuacucacaucauaagagugcccuguuuuucaugaaaggaugugagaaaagccaaaugaauucugugcuuuaucugugaagccaggacagugggcagugggcuauaauuuuugaauaugugugcauccaggguagagagaugggaaacagggugaguaccuucccugacuguguaaaaugcugcuugcccaagggagcuuccagugcccugcuguggugcccacuuggcaaaagcagaguguauuauaugaccccagacaaaaguucugcugcgcucgcuccaggucccauaagaucucccggcuggcuuaaggacccuggacauuuaaauaugaaugaauggcccaaaugaaugguucuggauucugucaggcagaacaaccagcugucucaggcagccccucugccccagucccagaccccugaccugugcuaccaaucugaggaccucccucagacccacagcaggaucagguggguucuuacuccaggaaagugcaaagccaugggagaugaccuggggacacuuuccuaucuagccaucucagugaauggaaacagugcauuuaauuugcuugccuuucucccuccaaagaaaaaaggugaggcaaggaaaaggauugagcagagaaagaugaaaagaaagagagagagagagagagaaagaaagaaaccccuagacuaaaagugaaccgauuuagaagaauuuauuguagaaaggacuggagugcccccccccccccauucuucagagaauggcaggauuggaagagaggugugugugagggagcaaggagcagcaagaaggcagccugucagaaacgggcugucccuccucccuagucacagcucauacucacagacgcccucccuccucccucucccauucacucacucacuuagggccaaucccucucucucucucucucucucucucucucucucucucucucucucucucucucucccucccucucucucucucuucucucucucucccuucccucccucucacucccuccccuucccuccccucccccucuccuucucucuuccuuucucccucccccucccuugcugucccucuuucucccccuuucccucugucuucucuucccccucucucuuuucucccugucucucccucccauccucucucagucucugucuccccccacccugucucuuccuuccucccucccucucucccucccucccucccucccucucucccucccuccuuccuucucuuuuacucggagacagucagaacucuccucccugacagccacaaaccuacagcacugacugcauucagagagggaaccugcaaacaaaacuucacagaaaacuuuuugcucuuguuccagagaauuugcugaagaggagaaggaaaaaaaaaguccaaaaaaaccugugcgugagggguggggaggaaaagcagggccuuuaaagaaggcaaccacacgacuuuugcugccaggaugcccuugcuuuggcugagaggauuucuguuggcaaguugcuggauuauagugaggaguucccccaccccaggauccgaggggcacggcucagccccggacugcccguccugugcgcuggccacccuuccgaaggauggaccuaacucucagccagagaugguagaggcugucaagaagcacaucuuaaacaugcugcacuugaagaagagacccgaugucacccagccggugcccaaggcggcgcuucucaacgcgaucagaaagcuucauguggguaaagugggggagaacggguauguggagauagaggacgacauuggcaggagggccgaaaugaaugaacucauggagcagaccucggagaucaucaccuuugccgagucaggugggugcuggcauugggagugggggcgggggcggggaaauguauuucguugacaguccuagcaggaacuucuuucccuccagcucaagaguguccggggagguuauuaguuauuaggugguggcgguggcggcggcgccggaguggcagaggagggggaaaggacuucuuugccagggagcccugccccgcaauggcuagcuuacacuugcuaaauaaacucagcgguuacccagagaggaagcucuugggccagucuggagcuggaaagcagucugcuuggggcucccugacugcccugccuaggaaaccagauuugaucaggcagaugaaagcagggcauuuggggguuugggggugcagaggcagcaucuggaccccauccaaaguuuuucugggguaggagugagagagccugggggccgagugcaaaggcacugaugauggcucugucugagaacaaauuuccuuuaaaugucugaucuggggccacauuggagccagacucugggcauauuuauuagugacaaucauuuucaccucuggaaaaccuaccucuaugaaaaacccaccgaagaagcaaagagcaacucguaggguauugaauuagugauuaauuuuggaacacugaaacuuuugcuguuagaacaaaaacaaaauaaaaacagaagcaacgagcgacaucaacaaaaagccagcgaaccuuacccccaacucaauuuuauuuuuuguaaagugacuaacuacuuuuugccaaggaauacaaucuugacaaugggcucucagacccuaugcugaacgacucaauccuuaagaggaaaaacuuucauggauucuaaucauuggcucaggaccacacuaaccuguugcuguggagaaaaauaccuguccaaagcccaggcucgaaacugagaacuccucuccagucaugaggauacagaucuuacugccaaucuguggggaccgggcacacagauguucuaaaaccucuuuacuuucauguuaaaugccaggcuaaggaauaggaucccuugccaaagccauuugaaaggaaugccauuguuuuguuugguggagcauaugggcuagugaagugugugcagggacucccagcauuuuguuuaaaaguuugcugcagcaguauaaacaauuaaggcaacacucaaaauuuccaauccugaaagccuguuaacucagauguucuguuuucaagaaagcugugcaagaccugggcauccuucuuucggggaggggggagaggagacagcuggcuugguggcuucacccacaggaagccuugguaccccaccagcuccuuagacagguuaguucuguccauguccuacuuccuuaacuaguuccuuuuuugacccaguuccccaaaccuuggucauugagacuuuauuuccugagccauauugaggaaagacaggugagaaagaaaaccucuccagcguugguuggugugugagggguggguucccugcuuuaggagauuggcccugguccugacacaaugugacucauauaagacucuauguacaagcuuccccuguguuggccacaacugcaguuucuacuaacuuggaaucaauuguaucaugugacuagguauaugugugacuuccaccauguuuaauggcacaguggauguuagcacucuguccuucccucugacuuacaaggcuuguacagaaaaccuaucacuuggcaguuagagguagggcaaagaauuaggucauuuucguucuuuuuacuucugaccuucucagugcuaauggaucucucacuuaagugggauccugucaguuuugcuucucuguuguuuaguuugagagaaaaugagcuacuauuuacaucagugauucacuggacucacacauugacugaguguaaaauuuauaagaggaaacuccuucuaguccaggaacaugguguuuuuguuacaauugcuuauuuucucaugugagaaguagcacacauugacuucaaguugauuuaauauaauuucacaaaugcaaguaagaucauaguguacaaccuacucuccaaguagcauagggugugacauaagcauguugcuuauucaggaaauauauuuauuaucugauuagcuagagaaaauaugugaaaaugaacuacaaagaucugucuuguuguuuuuggaacaauucuauuuugcuauguaguaacuaacacauuucaagaauagagaagggcaguuuuuuuuuuuuucuuuucuuuauaaccauuuggacaacauagggugcagucaaugacuguuaccuguaaacauacuauagaugugcuuuucaauagcaagaucccugguaugggaauguauguuuuacuuuggccucuucacucaagauuauuagauaaagcugagaaaaacaugagacugaagggacuguaagggcugugguacucugaccuuuuaagugaauuuguccuguguucaggugggaaguauuuugguuuugugaaguugauuugaauugcauuggcuaagcagcagauauucacucucaagcucccugcaaucugucccaauaagugaaauugauuuuauuuuuauaagugucacccaagagugcuucccaaaguuagcauauuuauugcaugacuggccccauaccauuacuccugauuuuucuucagaggaacagcaguaugggagagucaagccaauccagugacuguaacuuaauugucaaugaaauuggccuucucuaccaaugcacugaguuuuuucugcuuuuccuucuuuauaguugaugcucagugaauguauaguaccagccugcuguugcgucugcauagauuguggcauggucagcugcugauuuucacaauuagcuuacuggaguucuugcuacguaggauauagaaacaauagaagugauaccugcaaaaguauauacugcucagguguugucuaaaguagcucccuccccccucguggaggacaccaggaaaagaagauuugaauuagaaaugaggucaccugaagacuacuucuccacacccuaagaaagccaucuccaaaugaaguaaacaccaauagcuccauccccaaccuuucuuuugaccugucuugagaaaccuuuaagguuucacacuuaucugaauuugaaaaagacuggccacaagagggcgcaucccuaaacccucagcuacucugagaaaggcaguuuuguggguacuugaagccccagccuguagcaccuuaaucuugaagaauaucaguuacuuccucccuacauccccaccuuccugcagaguucagguuuuauaggcugggggaugcacagcuaccuuuaagaauacauugagucacagcacugaaagugcugggguccacaugaaaauuccacagcuccaugggcagcagaggagugauacaauucaaaaacaaacaaagcagggcuugggaugugggagaaucaucagcuacagugaugugagcgcagucuuucccuaacaaacaucuuccgucccccccccccccaauucugcuuccuaguuugccugccuuaucaaugcuuuucacaagggacaaaugacaagugacuugcaacagggaggaaaaagagacuauuuauuuaacgucugguaggaacauggaguucagcugcagaggacgcauuuguuucucgcugagaguguggagagaaaccgugggggaaggaugugccaagagaugagcacgggguuuugccuguagaguggguggacugaagugggaauggggagaugucaggggagagaugcaguuuucacauggagaaggagaaccuucccaggcacuucacaugaaaauacuuauuugucuuggcccuucuuacaucaaacuugaguaugaucucuucgcuuuaguucagaaugcuuuaugcuugacucguuccuggguccaacauuaaaaguguaaacguuuugaggaauucuaggaaaaaaaacucuuggguugacucuuuaggguuuuuuuuuucuuuuaauuuauauuaugaaguaagcugcuuguuuuggacauuuaacccuuuacaucauuauuuaaauggaaaaagcaauggauguuaagugacucaggccugaagaguuacaaauaauuaaaaaauggaucccaaggagagguauuaaagcuaaaugguuagacaggauaauuuauacaagcaagcuaauauaccugcaauggcaaaauucucuacuguaggucaaaggaaaaauaaccuuucagaucuuacucgcugccuuccgcagacaccucuggaagccauccagaggccgacuuagugcccgagagaacgcacaggcuguaguguaggcccuucaugcuccugacuguacuguaucuaggcacagggaaacuugaugaagaauggaaaauuuaaguaacacauauuuuacagcagagcugugcuccccucauggcaaguuuaaaugugcacugugaaugccaaggcuuucuacauuaacagagacgucauuauuaccgauuuguaaaagggcagcauauuuuacccaggauguugaugaggaaaaccagacuaauuaagcugaaacuuuauguguauacugauuauuuaauggggaauuaucagauaucccacaaaucugagaggaggacuuuuguguauguggaauuugcauaccuuuuaaguaaaaaggagccuguuuacuuaagccuuggcauaccuucaugaucaagcuagugagaaccccugaaagcaaaagagaauugcuacaaacauccuucuuuuaggcuuauguagacuuucucucaaggucccccaccaggcagcauuucaaugguauucucuauaagguacaaaauuuaucccuacugaguguucugcccauuuucuucugcuuuggugcguguccaccaagcucaugggggcuucggugaugagauauuaucacccacauggguuugcgugggacucugaugcugaguuacucagucagagcaggcuguaugauccaagccuugcucacaagccucaggacaaaaaauagcacagaggaggaaaagaauguuaccagggaguaguuaaugaaagguuacgcgcaagcagcucuagcuggggagcugcggccugguggaggaacccaguacacaccuguacacaccagcgccauguuuuaugccgcagcauugugggaaggcauucauuucaggauuucacagcaccagauacuuaaaucaggucugaaacagaugagaacuugagccuaaacauuucauccuuaagauaucuuucuuccuuuuuccaaaucauuacauguucagcuuggggccuccuggaaacgacauugcaauagaguaauuucucccagguaauagagauaaagggaauagaacaucuacuaauuauauuuuugaucguuauguaacuaacuggagaguuguaauauauuucugaaaccaacagaucugauaaacggucaguccacuucagcuuucguccaucucacccccccaccccucacacacacccucugcaaugaaagcuaagggaaaagaaaaaaaaaugcacugcuuaauaagucacaauacaauagaacuuguaaaauguaccugcgcgugagguagauggaggaagacuugauucucuccucccccuguccuccugggcauacggcaacagcauuuucaugaaauuggaucucaguuuuauuuuuuuuuuucccugauaaaauaucaugcaauacacaaauagcaguuccagaaauggacaccaggagaaggaggggacaggcaugucaauuaguaggggaaaauccaaaugucagaaauaugggggagagaugaagcaagcuagaauggauacaaauacagggagcagaagcuuucggcuggauaauuaaacugcugcauaaaucagugcuccugccucccgugacauacaggcaauggcuugcaguuaauugucagccaagaccagccugaaagucauuuuaugacgacucucugagccuaauguaacaacaccugacagacugagcccccucuaaugagcacucucuuuguacgauccucuugcaggaacacuaaaucauuugcuuccaaguacagccgccugugaagaagggguggggcuaccucacgcauuagaaacuuguucccaugaaauuaggugccauccuguaggcuguguaacaggagcaccuggucucagcccugcuggccaugauaaaaagcagcuccuaugcacugucacuuguucuagcaugccaauuaauccucucuugucccuacugcagcaucugcaguugucagcccaggacaguucaugggaagcccgguguugagcaggucagcaccucuuguuugccuccuuacccucacacccaugcuaaguguggaugggggcaguccagaguuugggaggagguugccugagaccuacugaaccuugccaggcaggaggcaggcaggugcuguuuccuagagaaaaaacagucuccacuggcuucucuaauuuggcugcuacuuuuguuuucucugucugacaccuugagaagcucagaguuuuagaaaggguccugccuagaggcaggaaggaaaaaugaugggaagcuagguggcauuuuuucuaaagguaauagcagaugcaucccauacagcaaaggaaccugaguuguuccaagcccucuuuagccuaucucuccuucucccuaaucucucuggaccccucugcccuucccuccuguaccuuaccacuguaugcucguaaaaacaacaaaccaacaauaaacucccucaaccuuaccaaagggugagauaggauuccacuuucaaaaacuauuaccauguuuuuuuuccucacugguccuugcuuuuauaugcuauggaaucaauaucuccucuuaauuauuuauuuuaacuccuaacaaaaauaugaagucacucagaggaaugccucuacuaccccaucuucuagacagauaacaggggauuuugagaauugaucaauacucuggucauaguuuacagggugggcuagacggagcuggggaucugcaggguaccaugcacagaacagccuuccuuccgcggcagagcauuugaaacugcgcugugcaaagagaaggaaacaucaaggaucuggcucuuuaacuagguagauaugaauaguugcugggauauauucucuuuuaaaagcauauagaaaguggaacaugcuuuugguauugauuuggugcaguuuagaugaacagagguaaaaauaaggaauucagagauaggaguugcuuuuuuucuuuucuuuucuuucuuucuuucuuuuuauguuuuuuuuuuggaguugcuuucuuaauguaaggcaguucaaugcuaauuugcucccauugguuaguaaucaaacaguuacccaccucugcuugguacagcacgacagugaaugggaugcauacggcuuaggccuucagauguccuaaacugaauugguaugagggugagaagggaggaagaggaaagugggguccgauugaauaauuuuugggauaauucaagugggguccaguuggauagcauuguuuugguugcucuggguggcacaggaacagccagugucacuguuauaagugaguugagugcauaaaguucacaggacaaaaauauccaggucacagagacauggaccuauaugaggcguacaguccaaagucaugggaaguuggacuacugcaaagcaacaguuguaacagaggggacagcacaaucagacccaccuuuaggaaagguuucuucaacugcuugauggagccaugacuugagaagggccugacuuaaaaguuuuaagggcccuuugaugaaaagccugcugcuguaaugggguugacagaggaguuaggucagauggugacaggaggaagacaugugucagaaaguauggccgcuacugacccacacauagcuacaguugacaagauuuugggcuucuguggaagaaccuucccugccuugcgcaggcauccaggguuuucuucuuugggcuucuguuuuaggucuuugcagaacugaggucucugcucaaauguccgcguaccauucucauuccgggauuaaacuaaaacaaaggagugaaugaaguggaugcagaaacccaggauuccuucaucagaaagcacggucuacaaacuugccucuguuagucaugucucccaucgcuacccaauccuguauaagugaagcaaggccauaggcaguguagaaagaaauaaacuucauuguguccuaauaaaacugcauucacaggcacuaaaguuugcacuucagguaaaguuaaacauguaaagaaaaauauuauuuuucuucaaucauuuccauacuguaaaacccuucucaacucaguggucacauggaagcagauuuauuucaugcgugggcuauaaauugcugacucuguauugugugcaauagcugauaagauucuuguuccucaaaguuagugauagauguacaauuuaguuaacaaguguucucucucucucucucucucucucucucucucucucucucuuguuuuucucucucuuguguuuuaucuuuaggcacagccaggaagacacugcacuuugagauuuccaaggaaggcagugaccugucaguaguggagcgugcagaaguguggcucuuccugaaaguccccaaggcuaacagaaccaggaccaaagucaccauccgucuauuucagcagcagaagcacccacagggcagcuuggacacgggggaugaggccgaggaaaugggcuuaaagggggagaggagugaacuguugcuaucagagaaaguaguugaugcucggaagaguaccuggcacaucuuuccaguguccagcagcauccagcgccugcuggaccagggaaagaguucccuggacgugcggauugcuugugagcagugccaggagaguggugccagucuagugcuucugggcaagaagaagaagaaagagguggauggagaugggaagaagaaagaugggagugacggagggcuggaagaggaaaaggaacagucacauagaccuuuccucaugcugcaggcuaggcaguccgaagaccacccucaucgcaggcguaggcggggcuuggagugcgacggcaaggucaacauuugcuguaagaaacaguucuuugucagcuucaaggacauuggcuggaaugacuggaucauugcucccucuggcuaucacgccaauuauugugagggggagugcccaagccacauagcaggcaccucuggguccucgcucuccuuccacucaacagucauuaaccacuaccgcaugaggggucacagccccuuugccaaccuuaagucaugcugugugcccaccaagcugagacccauguccaugcuguauuacgaugauggucaaaacaucaucaaaaaggacauucaaaacaugauuguggaggaguguggcugcuccuagagucgccaggucccagagaaaauggaucuagagaguccagagaagacaguggcaaaaugaagaaaaaaauauaagauuuaug

SEQ ID NO: 12499 - RNA, 79490 nt, Mus musculus
gaguuucgcgggaggaccuuggcgcguaaaccguaucccuucauucauugucagcagcagcuuccuggagccauuuuucagcugccggccgcagcacccgggcugccgccaccgccucgcaauccguugcaucggcugcccccgacgccuccaucccuccucggggccugauauccgugcggccgggacccuccucucuccagacccccgauuauuuuuggcccccggggccugugcggugcggaaaaauaaaaagaaaagagagagagaggguucggaagcgccgggaggggaggcgagaaggagagacuuggaaacuccggcugcaaauaauaaaagaaauugaaagcaauacguuaauauaucguaacacuaaaaaagagcaggagcgagagaugagaaaggggauccagcccgcccuggagcaguaccuggugaccgccggggguggggagggggcggcugucgucgccgccgccgcugcagccuccauggacaaaagggcacugcuagccagccccggcuucgccgccgccgccgccccgggcacguacauccagauccucacuacgaacccuuccaccacguccugugccaccucccuccaaaguggcgcccugaccgccggcccccuucuccccaguguccccggcacggagccggccgccagcagccucuacaccacgccacaaggacccuccagcagagucgggcugcugcagcagccaccagcaccaggacgcggcggcggcgguggcccaccgguaauacccuccucagcgucccuagcccaggugggaggcgggcucccgggagcgguggcggcgggagcgcgaggcugagcaucgugggccucguugcugucccuuccagcgugugcuuauuguuagacucggggugcuuuccugcggacguugggaggacgugggggccugggcaggcacgcggggcaguggggagucccucuuugagaaccacauccaacacuccaaaacuuuucgcgcccccccccccuccacuucuuuuccugcacuuuucccuacccccacucuccccucccuugcaacucgaagcuuccucuuucucgggcguaggaaggggucacgccccggauggagaagggggugggggagggaguagugcacuggagagugggggaccccagaggauguaaacugggggacccgaggcgugcaagccuccucuccugucucugcugccccugggcgacugggggucccgcaggcgugcuccgagcgcaggggcgccagugccuggcaccuuuggggaccuagcuccaggcaacaaaggggaucugggagguggacggguaucgcggugggggagguggagcugagagccccggugggccagggcucgcgcugucugcgacaaggggccggcgggcgggugcuccggccugggcgcaucuccgcgguggcagcggcggcgcccgcguggccggagcgcuggggccuugcucuccgggccccgggccugcccuugacccgccucuccccuugccccuuccuuccccgcccugucccccuccccgcccccccggcgacggagggcgggggcagccggguucccgucccgccgccaggaucugucccuucucuccgggacccgccggugacguuucgcacacgugcgcggaggacgcgccugugacuggggaggaggcggcggcgggagggggcgcuggagggggagagggggcacccacuuccuccugcucgccggcucccaggccugggacggucccggcgcccucgcacccggcaccgccacccucccucucccguccccacccccccacggcgcccgcccucgcccggcgccgccgcuccacucggccucgggcccccucuccagccggccccccaccucccccggagccaggcugcuuucggaaaugcccuuacagcagcagguuagugaccuggaccgcgcgggggcccgagccaccgccgcggggacccgggauccccggggggcccgagccggaggguaggcgacggagcgggguuuuggagugggaacgggggguugggugcuugagggaaaugaguaagcaagaaaaaucuaacuaaguaaauccccggccuccgcuucuaggagccccggggcgggaguggccgcccccgggguggguauaguguuuacguguguuucuuuugggggguggauggaugggcaauugaaacccugaugagggcuucacgcccguggccgaguugagcugcuuucugucuugcuucccuugugcuggagggggagggggcgggucagaggguagggugucugugggguucccaggccacccgccacccccucccuuugucccuguaauuuauaaagcgccuuugagagaugauuuaggucaguaugcggcuuuccuuuuuguugcuacuagaaagaaguguggccccgaggucucccucucuuccuuucucuccugcauuccuuccuccaugccuucugucuucacccucguguugugccuuggcccagaccagacuagaacccacccggacucggauaccuaugguugcaugauaauaccagucgaagaucucaccuagucuuaggucuagguguguuuguuucugcacgaucaguauuuugcuggggucucuuaagaaaguccguacacauauauaggacuuugggaaaugggguggguagcgaaagaauuaauuuucuuaaauuucuuuucuguuuauaauuuuccccuggguuggaucuugagugcuuuccagccuagagauacuuacuagggaugugugauagagacagucccagucaaagaggcucauccuuuuagugacuagggucugccagcaggggggaagccgaguacaguaccugcuuacacuguguacaguauccagugugcuagauucucaggcacaggauauauuccaugcuuucauuagugguaaauacuuuuacggacuugauuaaacaugcuugaccgugcagugcagcaagcccacucccccuacacacucgguuccuauaucauaaauaagcuggaacaacuggcuauugacacacuucuuggaucagauucagauuugcagggaaaguuauuuuugauaauaggaaauugugaggcuaguaaauugcucuuuaagaaauaucuuagauuauucauuggaccagcucacccaagacugucuaaccaaauuuauauguaguuuacuguaguuaaguacuugaaguauaaaauuauugcccucaccaccuuccauguuauuucuaaacuuuuauuguccuucuagccaugaaguuauuauuccaggaauauagauugaauuuguauacucaaaaauaauguuucauuauaggaauauaaaugccucuuacacauauuccgaaguaguuuuauguaagauuguaauguaugcugaaucacugguuaaucuaugcuuccagagcuguaucuugugggagggguaugaaguuuaucucccaggugcauacaaaguccuaagcguugcaggcaaugcuugauuuguuuauuauguuuuucuugucaguguuuccgaaggcuuccaguuaagucuuggaauuuauuugauuuuguuuuugaggcagggucuuuuauagccuugaaccccuggucuucuugccucaagugcccaaguucugagauuuaaaacaugcauagcccuguguuuuagaauucuguugauauuuuccccuaagcaugaagauugagaaggcauauggaaugaacuaagauaagacuaaacauucuauguucaagaagagguggggaauucuucaggugacaacaauucuagaccuaucugugucugcuuuucaaguuacaucucuagagcaucuaagaacuugacagugaguggcuugccuucuugcuaacuguaagccuccuggcuuguuuacaaguugucugcuauuaggccaauaacuuuaucugcccaaaugguuccgucuguaaggcagggcaauaauacugagacuuucuuuuuuuaagucaugguaaugaguguacaguacuuagcucaaggccuggcaaauaguuagcugccccauaaaauucguauuuaugaaucaaguauuucuguaacucagaaaugacuuagaugcuguuccucuguuuacugaugugagcagaaugcucauauguuuucuaaagugauauguaauuucauucuuccagaaaauugagacucuaucagugcaagaggcagccuaucaugucagauuuaauuuaauccagucagagcaaccugcugauuauacuuuuugagagaaccuucggugccugggaauuuccucugagauuggaggacuggggaugcaguuucagcagggacucuuucccacaacaacuuugagagaagaaaacguggggcuccugugguucugugugcaguaagcccgcuuccacugagacauacgguugaugccaaguugaggcuggaacagaaguuuuagucacuacauaccccaaaauggaacuuuuaauaaaauacaaugcccagacuugggcgguacaaauagcuccccuguagacaguacugagugggccacccuaagcauccuugggaaaaaagcaccuuuaacuuagucaaagcacccaaaccugagcacagaaaaggaugcguguguguaugugugugugugugugugugugugugugugugugugcgcgcgcgcguguauuuuucuaaauaucaccaccuuauauaauacuugcaaggacagagucugaguuuagcagugugcuguguaaaguuaacuugggaaaggaauauacucugggauuagaaauaaguaucagcgccugggaagugaaaggagagcaagagagggacaaaaagggagggaggaugguaggaggugucuuagaaauaagcaguaguuucuccuuagcuuuucugauucgaucaucuccagugagaacacacacacaaacacacacacacacacacacacacacacacacauauauuuaaucccuuuccaauuggcuuuuuuucccaacuuaacccugacuuauaaauagucuauaugacuggcuguaagcauugucccaagcuaaucaacucccaagucuuuucacucaucuacuuuuaaauaauauuuuaaucagggugggguagaaauuguuuacuugguuuacugagucccucgaaguccacgaagcuaccugaaauagcgcaaggaggagagauuccaguucuucccauccccaccugccaugcuuagaggaccaucccuaaguucucugggguacaaaguauguggucugaugcacacguucauggcugugagcagcuuuaaguaguguuucaggaauuguguuuacaguugcuaaggaguucccauccaauaauauuugaugggacugaggagacccgauaaaggggacaauauuauauauagaaaaccacagauguagggccuuucaccuccccauccugucuccuuuccaagaaugacuaggaaaauaaucucacacagagaagagguucugguacuaacuacagaagguagguaccagaaagcaaccuugcugggaugagaccagcaaagugggggugggguuaauacagccggauuauuuaucuggcuuucccauggagggggcguuugauuuauuuucgucacauacuuuugcuuuaaacauugccuuuaagcauuuaaguugcaagaauauguuucucuacccugcuugccuuagugggagucaaucuuguggccacaguuaccuguaacuuugaagaugugguaaagccaggauggaauccaaaggccccugugaacuuggcgacccuaaguaccaggucucgguuggugcuuuguccugguaaagcaggaguugugucagcuugaagauagcagauaguaugcagaagauagaauuaaugacccaauuguuugcggccguuuguaauguaaaggcauggcaacaucccucuaacuugacggacaguauuucagguuagcguauucaauauuugaucaaucagauggucuugggaguuaaacgcuuuuccuauccaaccacuucuuuuacagguaagacaaugacaggcccacugcaauuaaauuacucagcuaaggucacaagucaacagggggccccuccgagccaaaacugaaauuggagauuuuugcccucuuaaaaccucuuuuugugaggagaggguuaacugucuuacaugcccuacaugggaggcuuaggugugcagacuacuaaacucaaguuucuuucagaugcgguuacacugccccagagacacugagaaaucaaggcuacuuuagacacucaguggaaaggacuuguaaguggaaaggaacgacagguucccuaaauagugguagcaguguuuuucaaaguuugauauuugaaauuucaguuauuuguucuuuggaugugacauuucgggugcccugacagagacaguuuuacuuaaucaacaacagccucaaaggacuuuuuuaacuuucuugaaagaggggcaccaagggaaguguuguccggaaccaucuacaucccgagugacagucacgguuugcucccugggccuuugcauuagaccauugaccgagaggcucuuccucugugguuaacaccaggaagauuucugaugugucaaagcugccgaucacuuaacucuuucggaggaaguugucuaaagucaaagcucauuuccuuaaaaugaccuuuuuauuuuacuuguggaacugagaaagcuuaaaaauagaauugcuucaagcucugaagccagaacgugaaacaugauccaacaugauugcagcuccuagccugcccugggacagggguaucuguuuaucuguaauccaccagccaggaagguccccuguguguguaaaggcugacuuccugugagccaugaguagcaauugaugagagcccuguuaucagggaggcugaguuucucuggaagcacauaugauggcuagaggaggugaaugcccuuggccuucccugccagcucucgccagucugcucuggagaagccugcggaggcucuucgugcucuugagugauugcugagaagggcuccauccuguucuacucucacgagccuuguauggacucacaguuggaggaggugaacacagggucuaugcguuucacuccuuccugcacugagauguugggaaagcauagucaagaggagcgaccucgagucuugcuuacacuaccaucacgucuguccuuccgauuucagccucacuguccagagauggagucuugaguauaaaagacacacucuccuaaaagguggagugagagacagcuagguagaaaguuaagugauggaggcuggaguccucugguuuccuuuucugccuccacccgucagaugcucucuucauuucucaucuuucugggguagcgggguucucacaggugcaaggaguugaaaccagugucccacagaugucauagaggggccaggccaucucuuggcgcuguauuuugcgucuuguuuuuuuuucccacuauucuuuaguguccguuucauacuguuggcgccucugagagugauggugacugagagcgggaggcguguguccugguguggacauugccuggugcaaucauuggacccccggucuuuguuaccucuuucuaagcugcucauugacucgggaaaagaaacagaagaauaaguuuuuuauugucauggugcaaucugcagugccagugcuaugaauaaaaccuuuauuucucugauggaacauguucgugaaacggcacgaggaaugcaaauugcacuguuaacauaauuucaugucuguacaguaagccauaguuuaagacuggcucagaaauugcaugccaagcccuaucuaacuuggaggcgccuuggguauguauguuagggccaggaccaagucuugcucaccagaggccucuuaagcucccauggagccuuuuuaucccucauucucucuggguuuguuuuugagauggucucaugaagcacaggcuggccuccaggucuuaaucuagcugcagcugguuucaccucuugguccuccccagcacugagauucacccauaggagcgaugacacucuuccacaguugacauuccuuguguucucucugcuccgucugccucuugcaagucgcucagacuugcaguuggcucccuggcuuuuggguauugugaaaucuugauuugacuguucauugcugccuuguuuuuccugccucuuucucaucaguccuuccaggcccaccugaagaaaguucacacagaguauagucccagaguccccaagccuuggagcgcuuccguaaguggcuucgggcuuuuucuggugcaucauagauuuccuuauaucccuauuguuugggguuuugacuuuuuaccaaaccauccuggccagagaucgguguggccgguucuccacgugcucuuugcaaaggccucucugguuguagagugaaccacuugagaagagguguuuucgucagaugacuucaaugugcuuggcaccccgucagcucuguuggggauaggaaagaaggaugguaggaucugccugcuguugaguuuacagccuauuuggggagccaggcuuuaaauacaggucaaccugcaagcaauacuaaacaagaguuggaaagaaaacaaggcccaucucuagucccguguacgcugcagacaggaaguggcacgggagaguaugaggggcacuccacuccaccuggcuuucagaaccagaggccauggauccugcaauggcauaucucagggcuuaucagugugcaccuucaaauguuguugggugaauucuggcauagugguacauuccuuuaaucccaguauuugggaaguggagacaggaagauaaaaacuuuggcuauauauuaaguucaaggccacacaggcuacaugagacuauauuuuaaaaaaaaaaaaggguaucucugggacacuaaaaaauacauagauaccugggcccugcggagacuagcaaucgcugaggguaagacacagaucuaucuuuucuuugaugccccagaugauggugaugcgcugcccgucguaccaccggccagauggagagagaaagcuggcuucuuuaaugugccauacauuuuccauauggacuugaacccacaguagagcagcaggaagucaguuaucaugaaagccacuaguuggacugcuguuaguauuggggauaagaagacaaacgggucuguuaguagaaugggucuagaaguauuuaggagaauugcugagcucaaggccagucuggguuaaagugaggcccuguuucaaagaaauuggucuagaauagggguuuuggcuuucaugagcaggcacagugagggacaaauuggaauuaggggaaagugggacagagcuguucuuguagagaaaguggguauuaucaaaggggugccugggucccuggucuugaucuguggaugccagaggccaggguauuccuguguguugccagacauccaaucuaaccuacacgucuaccaguuuuaaaauacugguuugauugaagaggaaagugugaaggccaaaugaaauaggucucuaggcuagauuuggcuuaagggcugccacuccacaguagauggucuaugggauaauaauaggcagugcuuauagagugcccguggguaucgagggcacuagacggaaugccuuccucgccuuagcacguuagaugcguggaaaccuaugaaauggaugcuauuaccacucuuguuccacacggaaggaugcaggcugccagggguuaaggggcugguuuagggcccugauacuaagugggacaaccagacuuaaacccagggagacugcccucugagucucaacugauuuccucuuuauccucagugcccuugcaugguacauagcaggaaaccaaaguaccuguccaaaaugaaauaaguuagcauuuuuaccuggggggucaguuaaauaaccuucauucaaaguguuugggguaagaguguuuugauuugggacuuuaagacagccgcuuacugcuuaggccagcgucagccuaacuguguuugucaaggcccacccuaacuugccuccaugcacgugcugagauugaaggaaacaccauguuuggcagauguuuguuugcuaguuucuaauaaagugcuauuugcauauaaauaaugcacuguucuuaggagcaggucuaaacaccaguuaauuugugcugucaccacggauugaaggucauuuuacacguugcuuauaauaauuuuguguagggccccauucuaugauguuugagauucuuaaagucuuuccgauuuucagauuagagauauccaaccuguaguaagauuagccuuuagcauuuuauccaggcagagauuuccagcuccaucccuaaccuuaguuggaagccugacaucugauguugugaaauauguaggcagucacuaauaaaguuucuucagcaggcaagaaccucauagagaauauuugaugcuuaacccaucuuuuauuauagagaagaacagaccugaagaucuucaugccuacucugucaauacuaguuucgagauuucuaggucauugccaggaaaaccauccaaaaauauguuucacaaagcccagggugccuaguauggcagcacaugucuaaaucccagcucuggagaggcagaaagcccuggauguugaucuugggauuucacuggcuaccuagucuaguccuguucaugagcuucaggcucagugagagacccugucucaggacauaagguagagcuagauacgcauggugucacaugccuucaucccagcacucagaagggagagaugggcccaucucugaauuccaggcuaggaagagcuauacagugagauccugucugaaagaggaggaggaggaggggggggggagggggagggggaggagagaagaaauaauagguggaaaguagucuagacagaccagaugaguuccuuuggcuucugcacgcacccacucacacacauacagccacacgaauacacacauaaaacccaaagggaauaacaagaagggguuugccaagugacugaagaucuaaguuuggaaggucaaagugggaaaguuuccucuguccaggcacccacaccgacagaauucccugcuccgagugguuuagucuaucuguaggcuuucugaucuggucucugggaacagauaaccaaauggacuaagaacuggacuugaacuggaagagagcucgggcauguccuugaacucauggaugcugaagaacuggcauaagugggaagaggauggaaagcgggcggggauugcuagaucuuuugacucaagauauguaacucugggggcuggaagaagaguugaggcuuagcacagcccucauuguguggcucuccuguguggagggaauccucggggguggagagcaauauuuauuuauggucuuccuaagggucugggcugagcccuagaaguguuugaggcucuggcauagaaguuacaguagaauugcucagaaaccacaggccaaaacguagugguuucaguuuuuggagggaaaaaccacauagguguagaggcacagaaaccuucgacaauuuugcuucucuccguauaauaugaagacaugucagauucaucagauugauuggcuggggcuggggcuggggaaucaauacugucagggcucccagagacaaaccaucagauguuauuuaugccgcuuuuccaggccuggacauggcagcuaggcugcucugacagagaacuggggagcacaggaccaacagggggugcuauuuuucaggacaagucauguaauuaugucugcgaucaauguggccccuaucuuccuaauuugcugugcucuuuugauuuuuugcuaauaaggaaaaaaaaauaucaaaacuguuuuguuaugcugugucaaauugaaauuuuuagaugaugaggguguuucgggggauagagccaaguggauucuaaauaucuacaauuaaauuuuuuuaaauauguaacauguugaagccuguuuggaccacuccuugaauuaacugauuuuguuguuauauuggguagcaaaguguguaacaaucacacuaauacuguccuaagguuuccaggaauuuguguuacugcucugcuucuuagcaucucaggcgcccugaugcugggauagugaguuuccaggccuggcgagccaugacacagagguaggguauggaaggagcgugggacuuggcagucugacuccuuucccaguuaccagcgugugaccuuucaccagcuacauuggugagacacacuuaccuaaaaauagugauucugucucacuggcuggucggccagauuaaaugagaugguguuuauaggaaacaagauuuguauuuuccucuucccaagguaggacgaguccaguuuuggucuaacuuuccaggaaaucaagcugugaaaaaauaccucauugaacacuuguguguguguguguguguccuggugguacucuagggggcucacgaggugguuaauuugucuuugagguuuucuagcagugccucaguagacuggaguuguguucucuaaugaugaagaugauguacaagauagugaaauaauaccaaugguguuucuuaggcaccuagacuugggggcucaggaggacaggaaagcagccuugggaaaguuuaaaauagagcaagcccauuaaugucucguugaagaagauggucuugugcauuuaggauaccuagucugucuggccuccaugcuuguggacgccuguagcauccuggcagcugucacaaugaacauuggcuccagacauugcuaaauguccugggagcaaaagcaccauugauugagaaccacugcacuagaccuugaagaaagggguguuacagagaucaugcgugcaucucuucuauauauaccauaguauuuuuauaaguguauugaugugugugugcauguggaaggcaaaaacucagauguuccucaggugucacuucuuuuuuaaaauuuaaaggcccggauggucgcucauuggccuggaacuuacuaaauaggccgccuuggcuggcuguuaagccucacagaucuaccugugucugccucccuagagacgugcacuaccacaccuagcuuucuuaacauggguucugggacuugaacucgagcccucaaccuuauauggugagcacuuuaucaucuaaacugucuccuggcccuaaucauacauauguaucuuugugugugugagcaugcaugcaugugugcacauguagugucaauauuuuaaaucaucuaauauuuacaaauuuuaaauuugcaagcaagugguuccucauccugaguuuguacuuugaauugcccagccgcccugcagagugagcacacuauagcuuacuauuucuuggucuugguugaugguacuuuguguagcuggcugaagcucugucuguuugauaugacgagcauaauauuaguuugcugcaaggagccucucuggaacucagaccagaaagacuaaguccacacaguugggaaaaguaacuugcauugucauuguccuacccagaucaacugcuccacuugacuuuuaagcccagucuacauagcacuucacacuuggaauaguuugccuauaccgucuucuuccuauggccucuuuccuccugguuccugccucuaaggauagcagguaguugugaugagugcuggcugcagcuccucccauggcuggacacucuggaguucuugucuccaucaucuauaucauuaucacuuagucuggccuccgucucagagcagcugagcagcucggagcaacucuuucuucuuuccuucccuagguggcaaugucagccacuggcugcaggagcuaccuaacuuaagaguuacuuaacuuaaucggcaggaauguagagaaguggcccugugugucaccugauguuagggagagcgguaucggaacacagaauuccuuauccuauguggcuuuauaacuaaugaggaauagauacucacuucuguuacuguuucuggugcauuuugugcacuguggcucacgaugaggugaggggccguaaaccaguguuagcacguuggaacuucugaauguuuccccuugugggaccccaagaccuauugagucaaaaacuugagugucggagccaauagcugauuugaugaccaguuuugagagccagugcuuggggagaaaccaaggggcuuugauugggcugugguauucugugguaucaaauaaguguugcuuguguggugauucuagccucagaguuuacauacgugacuauuguuccgguaauucaagauggcagcacuuuguaggcgcguccuuguauggaccaaccaugguuuacgugggaugacugggaggguuccagcuaacagaaauucuuggucuuucauuggcuuuucaucaguaacacgaaaauauuaucuuugucuggagacuuuuuuuuuaauuuggagauaaaauugaauguagccuaggcuauccuugaacacuguggucagggauaaccuugaaaugcugcugaaucuccuaagugauagucacaggcuuguccccacuguguccuguccagucacuuguacuaugucuguuuuaucauuguuaaucuuauuuuaauuucuuagcuguuauuuuuuuuucugcucccguuaaaaaucuuuauguguguaaucaaauugccagccaagcacacaaggcugauuuggaaauggaauggugguucucccuuauguguuugguaguuugaguauuuaaagauacugugaggaguaaugaaaugguagaccaugggaaagaauccagcugggaacugggcccggcagagccgcaggagaaauguccauguaauuucuguccuguccacguucauuaggaaagccaaagcauuaaauaaacaacacaguucauuguaugaaaacuuugggguuccgcuugcauaugcauuaccaucauauaaauuagaacaggaagcauagaaucuaaagguuugauuuguuaaaacuuuuauuuuguaaauaaauaaaagggcugaagauauauagcaacagcgguagaguguuugccuagcuuguaucaggcccuaaaaccuacccccaauaccacaaaagggggggaaauaaagcuuuuugaaaaaggaauauuccuugguguguguguaugagagagagagagagaauauuuuguuuuuuaagaaauggccaaaucugcuugguagaaauacuuuacuuugaaccuuacucuguccucaaacccgaauaagauuacuauaaucuguccauucauuggucaucauucaguuuacgggcaugacuuacacauuaggagggguguuuggaacucugugcucauucuuuuugaacaaggucuuggccaugcauaggaaagacgaugagggucucaugauccaggugugucucgguucucuaaaaacagucucucugccaguggcauuuccucuuuuucuguccaccuugcgcucaaauaacuucuggcaacagcaguaguuuggagguugccauuugugguugguuuuacuacaggggccgugaaagaaaggcggaugguguucauuucuugcuuccugucuuguuggguguauaaggaucggcuucucuucuuggcuuuucagguugccuuucuguauagaaaagguagcccuuagauagccaccacccaugaccggcuaguuccauccaguccuaccacucuuccugaaggcagcccuacggccugaacuugacagucucuucucuugacuuacagaguaaaggaauaaaaauagagccauccugccuuaauaccaaugaguuucauaaauacuugucagacucuagugcuuggauuaucaacggaugaacucuugagucaguugcugugcacgugugaaggguguuggaggguaaauuggggucuugguucucaucuugugcguuugggggugagacucgggguggcgggcuucuuaucugcugagcccucucucugccuggagucuugcuuucaugucuucuguuaugugagcagucauguaaaaugccauugcguagccguccuuuuaagaaagguggucggucuucugccaucuuggagccccagagugaucccugugggaagaggcccugcucccaccuuacagacuuagaaauaaaguuuauugcucuggaagauugcuucgugucagucagaguuccaaaggcuaauaaauuuuaaaugcguacuucuuaauuuaccucaggaaauaauagucaagcagacaauuacaaauauuuuugugcuuaucagaggaagaauaaaugcguugaacagucccauuaguguuguccugcugcgauggucccuuucuggaguggaccuuggagacggaaguaucaccagcuguccaaggacuauauggaauggucacuuacuggggguuuaccucccucacucugauagggaacacugucuuuguuuauauagaaaauacuuaguucuaggauaugauuuuccuuuuucaaaucagaaaauagaaauugcaguaaaaauacccauaguccugcuucuuucccagacagagggaacugcaaugaaauguucgucugucuauuucauauccauuugcaaauaucuauuuaauauaaaaaggacaacugauuuuuaaaaaaggaauacaaaguggcuugcaaauucuacuccacacaguucgacaucucuccuuaccaacguaugcugauguguguuauucuugaugaaggccacucaugggauaugccagaagguauuugguuauucccacuugauuucuguuauuuuugauucuagcuguuacauuggcuggccacaaauagcccuucaucaacugcuaaugaggacacuaucauucaugucauacagcacaaacuaacccugcuguccccacgcccacugccgucacugcuauuguguauugugaaucucauccgucgggugaugaugccauuguugaauguuacugaguguccuuaacaaacuggagggcauaagacaacugcuagguauagccuuuuugugcagucaagagacucggucgcccugcaaguaggacuacacuuaaauuguugauaagagguauaauuauaggggaggaguaacucacccaguaaaauuaaguaugguaucacacacuuguaaucccagcucgggggaaguugagauaggaggaugccuugggcgcauuggccugccagccuggcuuuaucagugagucccugguaccagagaaagaccuugucucaaaagacaagauggaggaaccccgagguugaucucugugccugaucauaagagccuucccaccugaagaugugcauaugcauccgugagcacacacacaacgcauaacacagucuauguggaaguuagugaguaauaaauauuuucauuaucacauuguguguauccaugacuguguaccucugcuguuguaugacuggcaacaugggcuuauuuacaugagugucaauagcaucacaggaguagugcauugaguagacagacauauuaggacagccacugugucacuuuauaagaauucuucaguucuguuaacagucuuagggcaucagaguuuauaaguggucucauuaacuaaaugucaucuuauguacauaacuuuuuuuguguguguacaaaugugugucucaauaugucuugggauagcaggacgcauguauuauuaucccccccccccucuguaguuagaccuuuucucuccccguaagucccccaugaccuugguuauuaacuuaccuugcaauaucaggugcuucuuaugcuccacucaccugcucgcuuagaggggugggucugccguuuaaaagacagacucccauauccguagccucguugucuguaaauucaagcaaggauacaauauacuuuuaaaugcaucugcacuaaacaugcgcagacuuuucuucuugucucuacucucuaaacgaugcaguagagcagccguucucaacuugguucaaugacccuuucacaggggucgucuaaggccaucagaaaacaaagauuuacauuaugauuuauuacaguagcaaaaugacaguuaugaaguagcaaugaaauacuuuuaugguuggggucaccacaacaugagcuguauuaaagggucgcugugcuaggaagggugagaaccucugcaaucaaguaacagcuguguuaauacugcacggagguaaugaggauggacugaagugcaccucaaaccggaggguauaagggaggucucguagaagagagaagccaaggugauguccuuuugcuuaaacgacuuagcaucuuuggagcugggaccacagcaagguagugguucuugaacuaauccccaugggaacugaagaauaaccacaccaugaagguaauaacauccuagacgcucuggccagaggagacgucugcacaacccugggaguuuuuuaccuauucaaaaacaguguaaugugguuagagaaaugacagaucugugggaaguccagaaguacugcuuuccugaagaggaaacuuuaaaaaccaaggcaacucaacucaugugugugugugugugucugucugucugucuguguaugugugcaugucuguaugaaugugugcaugcguguagaugaggcagccuaucaucuacauagcucacacuugaacuauggaauuagguuauuuuaaaaguacccucaaagcaagugcuggaagacacccuagcaccacuacaauauggcauggagaggugggacagauuggaguggcgcuugugcuagggacagagguggaacugguaaugugaugguggugacaggcgagagaggacugaggucugcaugcuaucauugcccgguauggucagagagauguuuugcaacagccuggacacagacuccgcccccaccccucuggaccuucugccaggcuggggaauccccaacaaugauggaggccagggaugaagaaagguucacuuuguggauugaaggaccaccaugauccucgauggccucggaggccauguugauauccgugguccacgcugcugccccagaccgugaugaagccucccauucaugaugccuuggugauggcuucaggcuuugccgccucagggagccaugccaacgugaguggcaugugugagcaccugagaccauguugaggcucauggcaugggcuaagggccaugcugaugucuaauggccuguguuaacacugaagcccauguggauggaugcccgaguggguggggaggggugcucugccguccucagugcuguauguaguacagagguguuuguggucuaccccacagcucuccucagcugaugccuucuggcccagguacagccagagaaagacucaucgucccuugggggcuagcauucugaccguacuccagugaauauacaaaccacacaaauuauacuuuuaggggaggcaugggagguagacaugggaaggcugggagguaugaacuauuggggcaguuucccaaauaauugucuuagaaaaguacccucgucgggcaugguggggcacaccuuuaaucccagcacuugggagguagaggcagguggauuucugaguucgaggacagccuggucuacagcgugaguuccaggacagccagggcuacacagagaaacccugucucaaaaaccaaaaaauacccauaauggucuaaguuuauguguugggcuacauucauagcuauguggcuucaguuugggccugauggauccccccuuuucaccaaguaggguagccccuugagucuuccucucucugguguuuucugcuagcucucuuggcugaacaucaggagagugauuuucuuuggggaccuuugaggcugacucccuaacaaggcccagugaguucccaucaggcuucgaaaguaauccuauuuauuaguaguaauguauugauuguguguguagaauggacccagaggccugcaaccgugaguccauuugaauuauaauuuaagauuucugucaaaaucacugcugaaauggucgguccuaggacggaaacggggagucguugagugggauuuucggaauuuaguuggugugugugguggugauugguggggggggggggguguuuuacucagguuugcuugucuuuuuuuuuuuuuccagaaaucuccucuguguugugugugugugugugugugugugugugugugugugugugugagagagagagagagagagagagagagagagagagagaauguguaaaagagagagacagacagacagagauugauugguugguugauugauugauugauugauugacuauaggugcuugugugccaugaguaugugugaaagccaagaagacuaccucgaguauuggucuucacccugcaccguguuugagacgggucucuuaaaaaaaucucugacaguuccccugucuucgucucuaucucaauacaagggcauugcgauuauagacaaacacaguguucaaguccggcuuuaccuggggauuugaacucaguuccucacaauggccgagcuagcuagcacucuuacccaccgagccaucuccagccccacauccaaaguucuuuaaugcauguuuuuaucaacaguuaaauggaggcacuuaagucgcugucauaaagcauuuauaaaaaccugguuuugcuuuguuugcuuauuuauccauauuauaugauucugucuuagaccauagaaggguacuuggagcuaggaauguagcccagugguagcauccaugccauccccaugggcagcguccgucagaucaccaucuagccucacguuggcauuauggccauagguuggccuuuccagggcugugaccacuaugaucacuggggucugugugccuggaagccugaccuggccucugccuucuguccucccaugggcuuuccuaauacuaacaugucuucuuuaccauccucccuucccccaacacaacugcccuggcauccuggcuuuuuccauucucgacaaaugaucuguccacuguaacuguagcuaagcugugcugauaucuguugaaauuagaccuagaaucuaaauguggcuucgugaaaagaugggcaagacauuuuucucuucagagaaucuggauuauuggcauucaggccagcuccugguagcuucugaacugagauguggagggaagaaaauggaguaauaugcccggagcuugcuuagaauggcaguucuccauguggcccacacaguguuagcuuauguuguugcaaugggaugagguagagagcaguguuugcugccacugcaccugcguucucugaaccuguggacugacuucaaccugguggcaucucuuauguaacagaaauugcaaacucuccugguguccccuuuuuacagccauuccaacccccaaugaggcccaaagacuuaaugucuuaaccaauacugacugacugacuuauccaaguucuucuauguauuuggucauuucucccaacaguucgaaacaguaauuugguggaagcuaucucuacaacacaggucagugacaugccugaccccauuuguccugcaagaccauguggccauuauuuagaugaugagccaagacauugggcgaccacuuggggaagaagggucuccugggccacaggccauagugagguuugcuguguaaucagacuuggguugcagguccagauguggaccugugggcgcagagagauuuaaggcuaucuuccacucugucuguccacaaaaccacaggaaguuuugcuguuugaggcuuccuucugcaacugagcucuagaacccgccuucaagagcucacugagugcugccuccguucuuagugaugcugagaacuauuaaaaucuuauucugaaguugcaggugaggaaaggcguauggcgggucagaaggagacucgcccaauccccaaagaggaggcuagcuuuggacuucagcauugcuuggguuuaagaucacguguguucugggagcugggcaagucugucaugugggauaauugcaccuccuagacugaaagguggacuggggaaaaauaagguguguguggaucagcaaagggcuacaggaugacauagucaaguacuggcuucgagggugagcaugcgcaacugauccccacaacuuacauaaaaagaaagccaagcaugguggggcuucuuguaaucccagcucuguguacgcagaggugagggcuucagggcuugcuggguuuaagucuaaagugagcacugggccaaaccaccccggucucauaggaaauggggacuguggaacccaggugguccucuagccuuuccaagugugcgcacgaagugcauccacacacgugaugaccacacaugcuuucuuacuuuuaaaagaaggacucauaaaguugguucuugcuguggugagaaagcaagaacgugaagccagaagcagucccucaacacaacguuuugcauguaaaagguaggguacgucuuuguuuaacuuuacugugggucaaauggggcuuugugcacauacuguuuuuggaaguuaccuugcugugaucaguuuaauuguaaugaguuuuacacuuuguuucauuuuuauauggaugaaugguuuugccugcagguauguguaugugugugcaugcauguguagaggccagaggaugucugguuuccuggaauuagcaucaaggaugguugaaagcugucacaucagugcugggaacugggcccagguccuuuggaagaacagugagugcuauuuaaaaacuaagccauguguugagcccccugcaguggaauuucuuuuaaaacucugggaccucgggaacauuugauuugcuaaagcagacacuuaaugagaagcgugauaaggugccgcuucugucugggguucaucccuucauccaguguggagaugcugucugagccacacacacacacagacacacacacccauuaguuaccgaggcauccaugcaacagacugacugcuuucacaguauuugggcucaggaaaccuaaaugacuuaacaguggcguaacuguggcaacucggauucaccaacgggaagccaggaagugcuuccuuuaaguaaaaaggugaagguucucaacucagaacccaggcauggcugacauacgcaagacugucaguuagggccacagugucggaugggguucugaucgggugcaaaggacauuagauuuguggguaagagacgcaaagagaaaguguggucugacuuuguguuaggccagagaacauugugcuugaaugaggagaugagauccuuugagacaauuagaagucagguacacagauugcaaggguggcgcggggcggggcggggcagggggcguggacugauacuuguauuguuggaguauuugcgccuuguacuuguaugucaaggcuaguacuugaagguuggugucuccucaguugcucugucuuauuuuuugaggcagguccucuuccccaaacaugaaacucaccaacucagguaggcuuacugggcagcaaaucccagcagccucccguuucuaccucccuagugcugggauuacaggugaaugccgccacacccaucguaccucccacacuuaaccaucuccaaucauaacuuuaucucagauauuguacucuacaaaguguuaaauaauacaucucgaguaauuacuugccauaaggaaggaaauaauuucugaaagugauuuacaaaauguguucuauaguuacauucauuuguuucacaauguagcucaaauaaacugguguggugugacucccuggggagacuugaacaaaugucuaccuccuccaggcaagcaaagacgucaaaccaaagacgcaauaccagccaaaccugguuuggcgaaccaauuugaguugauuuaagggaauccaagugagaggugacuuucagaaacaugggagacucaggcagcugaggcacggcagagcccaucccagccuggcugaggacucaguagcggcaccccuggaguucucuuuuuaacuuugcaggcagcuccaccaaagacucucuuuuccaucaguucacagccuacacagccucagagagggaccccuccugagucauaugagcuucuaauauuucaugagccccucuucucguucauaagggaauguuucauacacggagggaauaauagcuacucaccacagggugaguaauguccuuuguaacauccagaaaccucagaaaccagaggcaaagcugggcaggagagagaauccuuugcauggucaugucagagauugccuggaaauccagcaaggcgaugagauuuaaaccccucgagugucgugucacucaugaauaguagaguuucuuuuaguguugaggaucagccaaagaaaagaaaagguggaggguggcuugagauucacuugggaacacacacacacacacacacacacacacacacacacacacacacacgaaaaaccuucaaaagacgauucacaaaugagaaugcagaguucuuccuggcucauccguguuagggcaccuguacccacguucugggagggaagcagcugucauagacugccaccugcaccuuuacaucucugugauuucaaaacaaguccauugauggcgagggacugggcagguaccucuggguaaagcauugguguguguguguguguguguguguguguguguguguaugaagaccugaguucggauccucaaaacccacaugucuauaguccucaggugcaaugaacucugucuuaaaauauaagauaaagggucuggagagauggcucaaugguuaaaggcacuggcugaucuucaaagagaggacuugagugugauucccagcauccacaugaccaggggaucugauaccuucuggccucuuugggcauacaggcaggcaaaacaacccauacacauuuuuuaaggugauucagcaggcaaauacacuuccuccaagacugaaccccugaguucgguuccugggaucuucaugguagaaggagaaaagcaacucuugggagguguccaccacaggcacaucauaguacauagaauaaaugugugugugugugcgcgcgcacaaaguuggaaagcaacugaggaagacagcugguguuggucuguggccuccauuugcauacagcacacacaaaaugaguccccuguaaugcuugcuagcuucugcgacuguaaaggugguuugggcccugugcugggucugcugaacucugguuccacagcucgucccuugacucccuccauuucccagccagcucugugcagacugaugguguugauggcucuaacauuaggugcacaugguacuuacugccuaguggucucaccaguggcuuccuagugccccugccacccacagcacccuguaagucaggacaguugaugcccgagaaacagccucucacccuggggcgauaaaugccacuggguggaugggugguacuuggaguuccauuuugaaugcuuccuagggagccgcagcagacucaggccacuguuuccuaucucuacaaccugguacuuucuggggucauuucuaguuaaaccguugaaacgugcucugguaguucuggagacccaaagcccaaggucauggucucaccagguugguguccccagagcgucacucugcugugcauaggugccugcugucacuauagccuugcuuuuucauacagaccagcggcauagugucaccaccugccccaaacaaagaccuuguuuuauaacuucaucucuuuaaaggugcugcugcaaaugcagugacauuuugagguccggggguuagggcuucagcacauggauuuauggggggggggcgucaccauuacuaacaccuaugaagaacaauuugggcuaggauaugugucuuucaauggaauuauuuggcuuugaguuuggagguuucacaaaacucuacuuuaucuaaaagugaccugcgguugaagucuuccaaugaguccgaacaaggaagaaagauggucccacuaggcagccauuuccucuuagucuauuggccugggacggccuggaagaagagcugcugucagacuggagaagugugacaccggcauaagaacacggugaacgguugagagaaccgcuuccaugcgguugagcaaaugaaggaacgguuaggauuaugggguggcugugguguggcccagaaacccucacacagaucuguguguggccugcagugcgaagggugaaugaugagaacagaauguagcaggggcagugaacaggcuccccuuggggcuucugugagggggugucagguagguguguuaggagcauggagcuuugagaaagggucuaugauagaauuguccagggaagccuugcagguguugccaacuugugcccugcccuggaccauggcacccccugcuuccucugccuggagcagccuggccucgcacagucaugucuugucauccacucugccucacuucuuguccugucauucacugucugaagucagaaucuuagcugacaucuacauaaugcuccauuauuugcuaaaugagugaaggcaaggcgcccauuacauacauacauacauacauacauacauacauacauacauacauacaaauuuaaauucacuuuuggaaacaaaacaaauguguuguccuaguuagaguuacuauugcugcagugaaacaacuucugcuucugugucauacauaguccaucaucaaaggaagccugggcaggcacucaaacagggaagguccuggagacaggaaaugaugcagaagccauggaagugugcuugcucauuauggcuugcucagcuugaauccaggaccaccagcucagagaagucacuacccacaauggcuggacccuuccccaucgaucacuaauuaaggaaaugccuuauaacuggauauuaugggggcauuuucucaguugaccuuucugaugacucuaguuugugucaaauuaacauaaaaguagcuaggacauauguagagucaagaggaacaacauaaaauaucuuacuuacugguuacugacaugacauuuuaacuauuccuuguuaaauuuuagcauuaagggggaaaaaaccuuaaauaaaauggagccagaccuucagaaggucgugaagaauuccaaaagcuagauuuuaaacagauuaucauuggacugaguucuggagaccauccauuguuuuauuuguugagauaaggucucguuagcccagccuggcuggccuggaacucacuauguggacuccaggguggccuuaggcuugcaguaguucucuguccucagcuuccugucugcugggauuguaggugcaccucacuguggugaccauguagauacucuguaacugauguuuauccuuccucaccuggacaagucccagcugccgauaauacauauauuuaucaugguuuuaagauuuuaaagcuacaggaguucuuuggaccuccuggaucuucaaaucuaacagguuuguuacuguaucauacauaccuuuuuggugcuuugaaaagcuguguuuccguacagggcauuuucuuggcauguuuuauuuuucagaguccaaaaacaguaggccuagaaagacugucauagccuuugcuagagggccggaaggaaggaggccacccccucaacucuaacuagggaacucagcugguacagauugccucgcaagaagggagcucugaguucaauccccagcacuguguaaacaagcuccccuggaguagggucggaaguucaaggccagccugggcuacuugagacccaaaucugggguggauguguguagaacaagaagcucugucuaggaagugcucagugcugugggcucaccccucccucugaagccgcucccacgucugucaguuuccgauaggguuauaauggucacugcucaguguaucaggacugccacaggauauccaggcuuugaugaaggagcagaaggaucugggacagcuggucaaaacaagcuuguccucccucgugggaggagggacagagcuuuccaguugaucuuuugguuaagaccuuaauuaaaaacagccucucgguccacuuguggcaagaauuuauuaaaggaaaacaaccaugagcaagccagugcugucuucucaaacagaggcccacaugggaaucccggcuuaaauucuggugaacuaacacaaggagccaagacaccacggacggguuacuuaacaguuugugaugcauguaauuagggggaggauugaucucugagaucuaagaaucuccguacuugaagacacugugauuuguggcuuaauuagaaacccuggugucauggugccagaaggaagagguauaguccuuaauuucccccugugccaccucagucuuaugccucgacaucucauuccauggaguccucauuauuaccggaagucucuugcuuguucuuuguaaaaaauagagagacagccacaaauuucuuccacagcgccuuagggugggcagcaaggcaucacuuuugugguguuugggagcagagggauucagguauugggcuucccugcccugacuccccguucacugcuccaugcuuuuaugguggcuuggugugagcgagcacuggggacuccacuaggacuuacagggaacuggguacauagccauagaaagaacgcuugacagauggaaccgugggaaaccuggauggugacccacugcaggccggcaucagagaagacacaggagcauggagccagagccgguugcagauagguguggccuugaacugagcaaggucccucggggguuuguuuguuccucccaacagcugcucuuugaagucuuaaaugguguauccauuuuacagaggaggagcuuaaggccuaggagaguuacaacaugcccaaauucguuacaauauccacaggcccaaaaccaugaagugggggaaaagccagcagccaacccagccuucuugcugcgagaggccugagcgugaucucuugguccuuuaguuugauggugagaucaagcuacuugggaauaauaaaaggcagagcaagagaagccuagggaccacacaaacacccccagccccgccccacgggguuuucucugagucacucacucuggcuggcucaaacugagaucagccugccucugccuccccaggcacggaccaccaugccgguuacgugagcuccccccaccccccaucuuaaaacaaguaaaccaaacccuggaugacagcaacaaaggauaauagaagaguaaaacaaaggcaguuuguucuuuuaaaggggaaagggggugggguagggugguaaggauugacuugcuggacagacaauaauugggaugacaugggagguaagaaugagcucuguuggauauauaauaauaauuuuaauaaugagugcugcuuuauuauagucuucccuggucucuuucaacauccucaaaaaaaaaagagaacuuuucaaacugagggaugcuugaccuuaacguacuugagauuaucaauuccaggcuguggcccuguuuauuagaugacuuccuuaaaagucccaggcuaggcaauagugaugccggccuuuaaucccugcagagacagauggaucucuugaguuaguggccagccaggcugcauugugagguucaggaaagaauaggaccuuaaagaccaaaggaauaucuacacugcuuaugguuuaagcuguucaacuccacugauguuguucugauaagaagagucaugcgaaaugaaagcauuaugguugggucaacuuacauagugggaaaucuuacaaaacuaaaaguuggucuguggggcuggagagauggguccguggauaagagugcuuuccugugccagugugagggucugaguuugaauccacaacacucauauaaaaagccaggcauggccagcugugucuaacucagcucgguccuguccucuacauagagcgugcaugugugugugugcgcgcgcgcgcacacacacggagggaucugucuguauucacagaugagaaaaagaaggcucaguuggcucaccaauaugguucgguaaagcaucaggcaagaacagcuccuuccauuucgacucaguuugguaguuugugacaugacaacaccggaguguucgauuuuugauguagaaagaagccguucuuauucuugggcauggaaguugaccuaagccaagguuggaaauacagugaaacaauccagucgucuacagaaaacguuaaaauuagggguuuuugaaaaguaguuuguuccuguaguguugguggauuguucucccgaacuuaaguaacagcuauguucacucagcaaaggggaaugggaaacuuuggagcaaaagccucuagcguccaguggaaaaacaguggucuguuccaaucugagugugugcgggggggggggggggggggacggggacggggacggggacgacacuaaaaccacuuuguuucauagccugguggggaagggacuggggaauuuccugucucuuuuccccuauccugguuugguaacgacuccagcagcaggggcuugcucaggaccagccugagcauugucgugugcacccacgcucugcuuggcuguaagauuuauuuaaugacaugugugacucugagacuauucaugauagugaauaccacagauuuggcuggguaacgugacaguuuuuauuugcuuuaaguuaacuuuagcuucuagugugguguguggcaaaagggcaccaaacuuggaucccagguucaaguuugauccuugacauuagccuucgccugagcaaacuugagagcucuguuuucuugauccaugaaaugggaauccuaacacuugugaacuuucucuuaggcgguggugaggggcuuugucaaauucaaagcaauggcaggcaggcaggcagcgagguaucaccccuauguucguuuuuccgauuuuuggauaaucaaguuaacauucccccgccccgccccguuuuguauuucugcuucuuguuugugauggguucucauguugccugauuaccuccuaacuccccugugcgugggaggcaagcccugagcuccgccuuccuauugccucuagguuccaagcgcuuagcuuacaggaugcuuucuuuaccuucucuccccuuuguauuuuuacccaguauuuuuuuucucuauggaagucuaaauauuguaaguuaggguauuucucuugcagccuuugucucuagugagcaaacuucaacuuuccacuccauauaauucaucauucucuugacaaauauuuuuguuuguuuuuguuuuccuucacuugguuaggucugaaacggucucucuguagccccugcugcucugggacucuguguagauacuguaacucgcucuguaggccaggcuggcugcuaaccagugaucagucuguuucucccuccccauguguugggauuaaagguguguaucgcuccuggcauauaugcgguuuuucaccaucuuaaaucagcucuuaggugugguuuuggcugcggaguagaaauugauaauugcguucugguuuucugugaguauuaccagucuggguaaacauggauaccagaguggguuuagugaaucaacagaaccacauacuuuuuccagcugucacuugcucuccgauucagaggccuggcuugauuggcuguaguuauucacacgggcaagccaguuguuuacaagcaaaaauuaauguaguauuagacugucauuuuaauugagguauucuuguaguaauuuggagauucucccccaagccaaaauaaauaaauaaauuuaguugauuugggagcuucccuuguugauguugggggguauaaaagggagguugauaguaugagguuuugggaaacacucaaaacuuaucuaaaauucugaccaaacauuuuuuucuuucuaauuuuucuaacaaaaaaauggaaacuccagcuguauaaauaaugauuuuuguuugaaacuauuucuucccuugcuuuuagaaccaucgagggaauucaauuauaaauaggacuuagcaaugaacaacugucacuguggaacagagugcaagguugcucuaguuuugacccuaugcuuuggguucagaggcuguggugaguguggcuggcggauaagccagcucuugguggagauggaaaggguucgugcacauguugcuuuuuauugucaucuuauuuguuaauuuauugcccaguugguuuugaugacuuaaaacaucuuuuucuuauuuuauguauauggguguuuugccugccugccucugugugugugugugucugugugucugugcaccacaugugugcagugcccauaagagccagaagagggcaguagauuaccgggaacuggaguugcagaguguugugagcugccauauuggggcugagaaucagccuccuggggagccaucagggcucuuaacuaucauuagcugaccucccccuccccccaccccagguauuuuaacugucuaaaauggcacuuucuguguauuugugugugugauaugagugggauuggggauggugaacaugcccuguguguacaccuggaagccagagguuaaccucaguuguuucuuuaucacuuuccaccuuacuaugggaugaggucguucagccuggaucuuagcaccuggcuggcaucuaucugucucuggccccugacucugggauuacaaucaauacagggcccuacccugcuuuuucaugggcacuggggaucaaacucgggaccucuugcuuacauagcaagcgcuuuaccccacuaaaccuucucccugccucuaaaaugagauuuuucuauaagaguuuacaagauugcuuuucagugcuacaguuuugaauguggccucaauucccauguuuucuuuagagggaugacuucuuuugauauagcccaauuaguagagugccguuuagcaugcaggaaacccuggguuccauccucagcacuucagccagguaaggugauguuugcauauaaugccagcacucagugggggcaggugcagaaguucaaggccaaccugaccuaagggagacccugucucaaaacaaaaagggauagcucgcauuuauuuauuccccagaccccauccuguuuagcacauguuguaggaaugccuaagucuauggccucugaucauuuucuuucuguagguuuguguuuuaguuauuaacaaggcuacuuauguguagucaggaugcaauagaaaacauucuugucaacaaaucacaugcuuucugauccuccuuauugcauagcaagguccccaugcuauuggacaauuaguuucaucacauuuuuuuauacauuuuuguuguuuuauuucauuuuguauuuuuugagguaggguuucugguggcccagaacuuauuaggccaggcuaaucucaaacucacagagauccaccugccucugucucuugagugccagaauuaaagacaugcaucaccauguccaacccuugucacauuuugaaaucagcuuuucuuccagggagucguuuuuauaauguucuccauuccacacauacuucagaaguguuacuuccaaagaaauuguugcaauuacuuaacacaaguuauucagaaaaaaaaaucacaagaaaaauguagucauuagucuaaagaaauagaagggagcgugacuuguguuagggggaaagccaacaaagaagagcucacugucagcccaggguguguguggucccuuaucucuggcuuguugguaggaagucauugauaccuguaugaaagaaggccgggaucuugucugcagcccacuagauguuuucuuuccaugcuggccuccagugcugauaguuaacccuuccugugggaaacuccucaggggugacuucuuucucuuggacguggaagccgccugcugaagcccacuuacucaaacucugcuuuccagauugaccuaugccuccuuuugccaggaauaaauucaguggacaucuugaaggagaagcguacagauggaugguuaugggaagggcagugaccaggguagaggaugggaaggaagguuucuacugcacugauggucagggucugccuucgugagagcaucuuagggaacuuguuucuaccuuaccaugguaacgaaggugggacaugcagauuugacuucuauauuugacuuaguauauauguguguuuauugugcauguguguacucuguacaggcauguagagguggguuuucucuagcuuuugagacagggucucucacugaaccuggaggugcccagugggcuccaggaaccuccuggcuuuuauacaugaguucuucggaucagguucuguggugccuggcauaggaagcauguuuaccaaugcaauagucucaccagccccagcauugaccaucuaacuguuauuagguguaggauccaguagaucugggugcaucuaucaugccugucuauuucaccauagacucccaguucucuccagccccucauggcgccuauucuguuuucugcucuccaugaacuugaccgcucuagauaacuuguagagauagaaccagacaucugucugagugguuuguuucaguuagcacagugucuuuaagcuugagccaugcuguggucuggaucagaaccuggcacuuucucugacagacagugauguuccuuuuuaaugugugcuaccauuuuguuuacccuucauguauugaagcgcucuguaguggugcggcugcacucucugguucccaccgauagcgcugcccggaugcuaggaugcuugcgcuuucucucuuugauccucucuggguauggggcugagaagaugguucagagaacuugcugaagaacgcuggcugcucuugcagagaggcuccggguuugguucccgguaucuguaccaacucauugggugugucuccagaaguagacuugcugucguacaguuacacagugauuaacuuuuugaagaacuguggggauuucuugcagcagcuguaccguuuuccauuccguguacagcagaaggccauggcagggggcguguuagcccuuuuggaugucaccugcagcuuucccuuaaucuaccucgucaucuucauuaaccccugccucuccccauauugugucugcucugugcuggggccuccuccccuggcccacuggcuucgguuuugcuguugaucugguuggauggaccuguccgucugugcccuccucagacugccaugagccuucucauucucuuggaagccaccccuguaauaggugcagcuucaugcgaaugaaaaauucauuccuguucugccagcccgaaggagcggcuccucacgugucaccuauuauuuuaccaauuaucucggugacucaggcgcuuuucauuccucaaagcgaaguuuagaguggugugagcuucugggauacucaguucugugaugcuuucugucguuccaguaacagcaagucuucggaggaaguugagaugaucugaaaugcuuuuacacuuucccuuggcuguguagcugugugggcccuacaucccgaugugauuccuugcacggagccauguagacaaagccuuuccugagcaguggguguuucgaauccuuguuucuuuguguggcauuaccuucaacuuaugaagccuuuaggggcagcaggugguuugugggugccaucaucuucuuaauagauaaggaagaugccaacacagacauucuuggaucuaucuccccaagaguuuucuggggugccauuugggggcacuagggaggagccaggccauccacuuuccuuucugugaccaaccuccauagacaguccccagguccggggcaaccaacccuucuugacauugguuuguugcugauuuucucauggaaucaccaccgugcuggauuuuguaugugcgcacgguaaccaugguaaaccauucaaucaagaucugaaauccucagcuggggaccguuccuaauaccauguuuaacaugauugauugugguacuuuggauggcaugugaauucugguagggcuggccuucacacgugaugugacgugugucugcugccacaugucuuccgaaaacccacggggcuuugccuuuaugucguaugaauuuccuguccauccucugauauuuauuagcuucagaauggcggcggggugcucucucagcucagucccccacugucccagacacuuuuaacagaccacauguuuacaacaugacaugcuguuguuuuagguagauauuaacauuaacaaagucauuuugguugagacagucucuucgugguuaggccuggcuuuaaacuuauguuaauccuccuauccccacuguaccugggcuaacgugugugggccaccgugcuugauuaacauguuuaucauaaaguaagcuugauucaggcccucagaauagcauuucuguguagcuacguaguugacgcuugagacugaugaaugauguguuugguucuuagcucauuccuccugaaaagaauagcuaaguacccacugauccccagugagccgucaggcauuggccgucaccucuuccgcaagccgggcugggguguguuuugcuggugugcccagaagacagugcaggaagccagccccagcuuugcaguguuuuacagccuguuuggaugcucacuggcaagcaagcgggggucccuagaaauuaagucuuagggaaaauuacaagucaauccgagggccuugggaagucccccugagucaugggugggugugguagcauugagauguugggccucuagagccacccagauccaacucuuuggucuguuuguccccaggcccggcacagcucucaacacaggagguuuagaacugaccugcacugaccuugauggccuuagggcccuuggcaagucugaguccucugggucucaucuucauuaggauggagaguugggggucagagcacagcuacuugcuccuuucagauaagacuucuuggugacucaggugucaucuuugaaaagaacaguguuugccuugucuuccuucucauguugacaaggcuuugggaacacuacccaucgauuguuaacuaggaacccccuggauacuaaaagcacgggucuuccauaaaagguaguaaguaguacacccuacccucuccuaccuuuguccacucagggucauuucuaauagcaguguagugcuguacuacaauuaauacuagguuguuugugggaauaauuaaacaagcacaugugcugcccagacagcucgacucccccuggguagccucagcccuugguugguuaacuguacaaaugccuacuuuuguccuuuuugaaaaccaaaaaaauuauuuuuaguaauuuuguggggggagaccuugugucucuuggggcuggaguuucagguggguguuagcugucugauguggguucucagcaccaagcauucucauccacugagccagcucucuggccccaucuucuccguuccugagacaugcguucuuucucauucguccauuugaauuccauccuugcuccccucagcauuugcugauaaaacaugguacaucuuguaauccuggcugcauguaaccaggaaguuugucuucacucuuggaggcagcacaguaugaucacuacuaauagugauuaaaaaggcuuggguauaaugaucacgacagagccaauauucugggguucaugucuccagccugcaucuuuuaucguccagagucguccucacugugacaccacggaaguacccuaucuugaaguuuccugaauagcagaaaaguuuugcuguguuaccuccuccuuggcggcgaggaggaggugggucuggcuuaaagcaggaggcucuuauguaucaucaaccaugcuuauuuucguggaguuauuucaacgaaggcuuuuguauggauuuacccuugaagccauugagauauguauuugauaugcaugggagguucgugaaacuccacagaugaugcucaagguugaaaucaucgcugaacaugauguaggagaccuguuuguggacuaggaauuagcaugagcuuuguaacuacucguuauaguauucuggauuauguauacaggauggacagcucaacacugaaagggagccuaagacgcucaaagcaaaaaucaaauccguguauaccaacagcagguuugugaaauguuaccauuuuguaaugggauacaaccaccuuagacccauaugugguccuucugugaauugucuuucugguuaauaucaggaugugauaaguuagauuaauguaucggcuugugucuugucaggaaauauagguaggucuucagagccuaaagaucuaggaauuuccacacuguccuguuuaaugucacaguggaggaagaguccccagccagggccuggugcuccacagcaggugauaggugugggggaaggguaaccuuucccugugaaguuucuugccuggaggacaaaaagguuaagcaaugcaguguuauuaaaggggcgugugcaugcacauggucguggauccaggcacaaccacaagagagaaaaacagguaauucuugcuauuuuuugccuucuaucagacaaguucuccuugcccugugguacaggaauggcguugugacccccaaaugacugaguuuccuaucuaggacccuggacucuaaacuugagcgagucuuggcaguucacugccguagaacacugacucuccagcaacuuucugggguuuccuuccccaguaaaggcagugaccugugcugaugaggccuccaaaaauccuuauugaauccauggugaauuagaaaauacacuuccacuaugccaucuugugcaggcguuguuauacaauuagaaauucaguaucuaagaagauagacugauguaauauugucggggguggggugggugggaagguagguuacaagcuuguucuuccauuguaaacugucaccaauagucacuucuauucuuuuuuucuaagauuuauuauuuguguguaugucucucucucucucucucucucucucucucucucucuguaugguguguggugugugugugugugugugugugugugugugugugugugugugugcgcgcacuuggagguuagaauagagcauccaaccuggagcuguaguuacagcuguauguaugcacgguacccauagaggcaagaagagagcaucaacuccccugaaacuggaguuacaggaagucgugagcaaccaugugggugccuggaaucgaaccugggucuuuggaagagcaaccggcgcacuuaacaacuugagugagccaucucuuuauuccuguauuuuauucuugauaguagauggggguuuucaggugaccagaguaagcuguaaaaauucaauggccuggaaucuaaauuuuaguuaucacaacugucuuugcugcugagccagcuuggaccagagugaacuagagccacagcgaggaccagucucgcuccauccuuugggcauuccuguuuccgcgaggccucauucuuucugcagguggauuacagaugaugaugugcaaagcugagcaauggauaguggaagcuaguacauaaugggcuccuuguggcuuugaguaucuugagugcccccagcacacagccuagaagccacuccugacaggcacagauccauccgcucuuggaggcgugcgagcuugugcgagcagccaugcugccuugggugcuaauguacacccuccugcugguuucucagggccgagcaucauuuggaggcuugcagacuucccccuguugcagggcugacagcuugggagaugcucuucuggugcuuugccauaucuccagcaaaguuaaacgcuugucuuuauuuuauacacccgugcagcagcaggccgaccagagaugcuuuuuauuuuauauuuuauaggggagcuuuuuaaaggguaugaagcagggcauaaugguccaaaccugaaauuucaguaaguggggaacuaaacaaacaaauaaaaagguuacaaagaagaaaggaauacauuuauguaaaggguuagggaggaagcucuugguggagcacuugguuucacaagcacaggacccuggguuugauucccagcauggcaacagcaggaauguagaaacuagagauagccccagccucucuccagacagucauggaggaacuuagggugcugggacuuuuauacuguauccgaaaguaucaccuucacugugaauuagcuaaauggcaaauuugagaggguggggaggaccgggucagauuuucccgccugguccagggaauuucgaguuugaagucuuuaauuagggguucuuguugauugugcguuaaaacaaagcuggaggugucuggaaguaagaaaccuaugcagacaucagaacucaccuaacagcuucagcuggaaagagauguaaguucauuguguuaauuggaagggagaauguauagaaagugaaugaucccuuaaagcuaaaagccuggcugcuuucaucucagaguucugcuuuagugcugugucucuggaaaguccgugucugcaggguggacuuugccacgggaguccugccaucucugaggucagcaauaccuuugguucaguuggugacuucguucccauuuaccaaguuuuuucguuuaacuuugggcugugcugaaaauauaccuguaagauaagauguuccuguguguacugaaauuuucucuguguaccugugaaugugugcacgugugugugggggcuggaagucagccucugguguccuuccuugggagacuucaacccuguguuuauuagacaggguuucugcauugcccuggaggucacccguuguagugaccuggaggucacuagguuggcuggcuaucgagccccagagauucauguguccaccuccccaggccgggauugcaagggaauaucugcaugcucugaugugcgcucucucucucucucucucucucucucucucucucucuguguguguguguguguguguguguguguguguguguguguguguuguuguuguuguugaugauugauuuucggauuuguuuaguuuugagaugcagucucucaccguguggcccuggcucuucuggaagucacagaaaaccucugccccccgcgguaaacacccugcacuucuggcauauucaguguggguccuggaaucagacucugcaccuaauacuugcacaguaagcauuuugucaacugagcagaauccccagcuguugucauuuugacauagucgaaugcucugcaguaauuguuagaaggaagccuccgugggaagcuacacuuggacucuugcuggccagucuguuccgguugcagcuguccuaauggcuuuuacaggcugacaauguuacuacauguucauagguucuuccacgguuuaggagacgcaaggauuuuuggauuuuuuuuuuuuuuuuuuuuuuuugacaggguuuugccguguaucgcuggcugaucuagaacuccauuugcagaucaggcuggcuucguacucggaucugucugccucugucucuggacuucuggguauaaagaugugugccaucaugcccaguucaaagauuuuuuaaaucuguuuuuuaauuuuacuuuguguacaauaugagagauugagagaaagagagaaagagagagagagagagagagagagagagagagagagagagaaugcaaggucacuguauauuauggaaaucaaagcagaauuuggagaagucaguucccugugccacagcgguccagaggauuuaccucagaugucucuacccacugaaccaucuaccgccucagcagcccucugauuugcuuguuacccugucgucuuagaacagauggcaagguagcaguugcuugcgcauugaacaacacugaguuuuccaggcccaugaauaaugagucuaccaaauaaaucgucagucugcauccuugcccagaccaacuaccacucuaccacucaaacuacaugccggugacuguacuuuugagacuaaguugccagugcuggcauuggacccacucuagcccaagggguccuuggauuugcacuccucuggccucacucucucugguagcugggauuacagacuugcucugugggcccagcuugauuuccuuuccaagaacugauguauuuugcacuaaugguagcuuaggagagcuucaccagcagagaagguuauuguacauucuggaugccugccauucucaugcagaaaaauguacaauagccauaugguuugaguuuguauagcuaaaaauugaaagagguugagcaccccgucauuugugucucucuucucucugucucucucucccucucccucucccucccucccucccucccucccucuuucucucucccucccucucucucucucucccucucucucugucugucucucucccucccccucucucucccccucucucccucccucucucucucucccucccucucucccucccccucucccucccucucucucccucccuccuucccucccucucgcucucccugucucucauauugcauucucugaugugauuugcuuuucuuccaauucguuuuuugucucuuugaucugugaggucuuuauaaagaugagggagcuugccuuuaauucuaauauguccuccagaauuucuccccacuugaucauuuccuauaugccugcuaacagauguugaguguguuugugugauacccacguccacacguccacaugcucucugagaccuuggauccaccugucugccuccccgaugcuggcuuacagauguucacugcccuguccagcguuuaccuuggguaucagaccucagagcuccaugccugaacagcaagugcuuggccagccugaacccuagaaguuacuuuuuuuuuuguuuuguguuuuuguuuuuguuuugcuuucaagacagcauuucuccguagcccaggccuuccuggagacccacccgccucugcccagugcuaggauuacagaugugugcuaccauggccuggccagaggugacuuuuuauagagcacauuucuucuuaacuuuccagcuccugaauuauggaucacggagagccucuuuuacuguccccucacacauaaaagaguugauucuuguuucauacaggaccucugugguaucacccuuucuguuuaaauauaugauccauuugcugugugucccauacucugaagaagaugccccggcccauggccuaugccucuauuauaaaauuuuuuaaauggaaaguauacacugugcccaugugaaaccauaaacuauggguuacuguuggggagcuggggguggguuuagguccuuuuguagcuuaaggccgugccaggcucucuccuucaagaguaacaauguuaagccuugaacaugaaugaguaaacccagaguccgccugugcgcucagaccuaaggggaugaugaaauuuugccuuuuggaacaagucccaagauauacccgaagacagcgucccauuuuccuugaaguguuucaguuucauucuuuauuaccgggccugaggcugaauagaaacuucucuuguuaaugugaggaugcucaaagucauaucugcauuauuuggaaguugccaggaauggcugcuccuaucuuugaccaauuaucaaaguuuuuguggcaaaugccaagguccagggauaguacuagcucaguugguagagcgcuugccuaucaugugugaagcucuggcacucccuguacuucguacaucagaugagguagugaacacugguaaucucaguccuugagggaggagcccgaguucucagucauccucacuacguagcagguucaaggucagcuagggcuacgugaggcuacugucucaaaaaaccaaaaccgccaccaccaacaacaaaaaagcccugcucccagcgaggcucagucagucagagaugugugaugugaaaaucggagaauggagauuauucggcguggccgcacuggaaaggggaacagauaaggguuacauccacguauugcuccccuccccagaccccuuggaguccguccuugagguccugacuuuaggacuuggcuuaucagggggggcaaaagauguccugggccauccagccuuggucagagcggucccugcccaccagcucagcuucacucuugcggacagacggucugauaucugauuguugaucuguuccuugcugucauuccugugguggauucauaccaacugacugauucaggugcagcguugucuucuuuuggggaugagcuuuucuggaauugaaggugacugaagagaaaagguuaagaccugugacaaaucucugugcucucagcaaacguaaagacgggggcagaauggaagcagagaagccaggcuuuccugccgucuagagauuggacaucuuguuacuguguagacccaaguguggagucagccacccaugauccugcaugcagggccccaagagccugacucuuagagccuucccggggaaucugagcaugcucccgugugaguccugugacgugcuuagaagucguauucaauuuuguaauagcagaucacggucuuggcggugcugccaucugagugggugagauuggcccuucuuggcauguagcaguguaaggacuuaggacauggugauaucuguuauuugacucuggugugcuuaggagugggaaauuucuuaaggaauuuuccggagcucacagagucacuuuggacuucguugcauccaaaauccugccgccgacugggccagugcuucccaaugucauauaauuaaaaaccagaagaacggguuuccagaauaugcuaggaaguuuuguggcccuggaaacuuguuuaccccccaacaaaagcagcauuguucuuccucgucccucuccccucugccuucaaagauaaucugacaccagaauggaauacauauuuauuuaccugcgguggccuugggccagagaaagcagggcucgcccacacagcaguaacuuccaaaccucacugugcccaucugaaacucagggcagcuuuacaggacagaauccccuagaucccuuugcaaaaucuagcauuaccccacccacgucuguguaaacaaguccaugccucaagagugagaccugggaguggguuuuccucaaguucccccagacauuuucaucguguacgcaagucugagaacugagccuuuaaagccauggaguuucuuaucacagggaccacacaggagaaagaagcaugagccagugggaaaggcccuugcuaccaagguugaagaacugaguuugacccucaggaccaacauggcagaaggagggaauugacuccuagguuguccucuagccuccauguggacaccauagcauaugcaugcaagugcgcacacacacaauagacaaacaaauacagaaauguaguacaaaggaagagcuccuuaggguaaguauaguuagaacaagaaaugggucauuuauguagcaacucacauggauggcuuucccaucugagaagaacucgggcugcagugugucuguuucuuucuggauuucuccguaauggucuuacuuguugauuuugcuggcuacaagcacagguaauaaaaugccaguggccacccgugccagggaggucagggcuggacuuuccuauuuggcuccguuuugauggcauuagcagauuaauuugaaccccuucuggagccuuugaccucuugcaggguugugcugucuuugagagcaacaguccuuucuagaucauagcaacaguugagaauccuucuuaggaaauccguggcucuucugcgaaaauuucccgguagagucuuccaaagucuuccacaaggaggggaggaggcagauuaagaaaacaacuacucaucguaguucugaaggugucccagggcucgggugcuccaguggcauuaaugggaaggcuguguggucauaaaaagaauguaaucccagcacugucgagauggagcaggggaaccuagcaacucccuacacagccaagccagucuaaggaaugugcagccaccagguacagugaggcacaacccuuuaucaaacagugagguggaaaagcaguugacaagaaaacugauguccaccucuggcucccacuccgugugcacacacacacacuauguacucacaaaagacaccaagcuugugaaccucacuagugugaggcuucagacacugaaggcauuccuaggacaucuccucuucacuuucuacagcucagacccacuggauccacagcucagcuaaggucucuugccugcugcccaggcaggguuaaauaauaauaaguucuauuuugcugacuugcaaaaucagcugucugcuagugcagcagaagucaugucuuuuuuuaacauagauauucguguuuuuuuuuuuuuauuugccucugugaacggcugcgggcagugguuuaaagaaccugcucuaaauuguggugugagucaaguaauccuugcuuugacuccuuguuguguauggaaugucagccuccaugcacaagaguaaacaaugaaaagugugaauagaagcacuuuggaagggggagguuaguguuaguccacuaauaggaaaaacagaccauagucacuacaggaccaacccaugugucuaaaacuauugggcuuuggggaauugugugcuuuggauagauaaauaauaugaacagauccauaagcuuuggcuacuuuguagaaauccugagauucuugucuacccuauguguguugcuuuuuaauuagaugguuacuuugcauuaauaaugauaacguugaaaaaagccagcucugcugacaggaaucuccacgugugucucugggguucuggggaguucacuuggggucagucaucgaggaaagcaugcuucugagaccugugaauuaacuuggucacaggugagcuuucccagcuaugcagcgggggaggggaagucgugggaggaugugacgcacauagcccuccaaggugaguaguuucucccuguucucuugaguuaaucuagaaauaauguagucuagagagacccuguucccagccuugucauguucaaacagcauggaacucccuaaaccuuuuccacauugaucauaaagaauguguuuuaagcaauucccugguauacauguaauuuuucaaguaguaaagaugaaagcaaacuugcacacuaaugagauggauaugucugccugauacuguacaauucaaagauacacuaauuugguauuuacguggaugcucucauaauacuuagggaugauagcagggaaagaauaaaaguauuuguuuuccauaauuaaacuacugcguuucuguaggcacacaagcuuugugcauacaguaaaauuguuacauuuuuaugacacagauaaucuuaaaucugagccaacauguugcaggcaaggugcacuuguguuccauggugugacgacaugcacaguacagagugugugcuguauguucaaggcuggggccaggaagauggcuuagcugguaaaggugcccgaccuuaugcccaacggccugauuucauucuccagaauucacguggugggaagagaauggacucaaaccucugacguucacaaauacacacacaauaaauuaaaaaaaaaaaacaccaaggcuuuugagcacugucaaaaaugccucaguucacuucaucuuugaauuuuaauuuuguuuugcucaagagucccuuaauagugccagauuuucaucaucccccucauuaguuacgugaccccauagagggucaugaaggagcuacuaagauggguggguagccaaaggcacccgcucccaggcugacacuuggccugauccccuaggacacacaagcuagaaggagagaacugacugcugcaaagggguguguguguguguguguguguguguguguguguguguguguguguguguguauacauguacacaacaugcaaauuuaauauauaaguguaaaaauagcagcuuugaacuguuuucuuagcucucugcuuggucuccuuucccauaaauaccuaugaaaugguaucuaaugcuuagaauuauuacaagguacauaagcuagaaguaguuagaagguaaauggcuuggaaaauagaauuuucaaaggagacagacucucagauuggucacuuagcuguacuugccacuguggcuccuagaugccuuacuuuaugcucagugugagcuaacuccggguucacguaaauagcugguugcccugugaugauggagcuagagaguaaggcgaggacucuugauaacagugggcugcuguugauuuuaucuuaguaaaaguuauccguguugcccuuuucuuguacaaugcacuaacauuuguuccaagcucguuuuaaugaagaacacguuuauuucuccguguuuagugacuucagaaucaucaggcuuguauauuuccagagcugcagcucuccucuuuuccagcccacauuucuuaccaccuuucuuccuaguguuuucccaauccuuuuaugugcaucugaaaaaugaacaugauuucauauguauucauuaggagucccugccagaggccuuucuguuugauuuuuuuuuccccucugaaccucaaagguaaugacuccuuauagaguagaaaaaagcuaacccgggccuuguucugcacuuccauggguaagugagagaauuuccaaccacagccucucaaaacauuugcccacauuaguuguaauggggaguuaaagccuugcucgggcgggcggaguccucguaagccaacugccgagggagaguggcuggagcuguguugugcuggggggauccauccaugcucccccaaccgaggugccauaugagugacacugauacucuccagcuaggcuccucugcaggcuacuguacuucccucaguguggagaaucuucugguggggcucucuagaugcgccuggaucccuugucuuugauguuguuuacagaucuuaagagauaggcaaugggugucaaagugccaguuaacuuguuucccacagguucuguuccauucuuuacacaccgagauggcucagaaguggauuguauguggauaggaugauguucuguaauccuggugcuucccuggcgauaacugggaaaccugagucuacuauucugaaggacauuucaucauaagccccucuucugaggcuuugaaaaugguuuaacgacuucaaaagccauucagccugaggugguacaugccuuuaaucccagcacuuuggauacugagucagguggaucucugugaguuucaggccagccugguuuguauagcaaggugcaggccauauaggguauauaagaaagaccuugucucaaaaaauuuaaaagaaaaauuaaauuaaauuuuaaguggccugauccuguguuuccuuauugaguguguugggcaggguuggggagggagcguaugaaguugggucucugcaagauuuuccaguuacuuggucuuuaguaauauaguaagagggcacuucagagaaaugaacaucaaguggaagguaaucacuggguuuaucugguuuuuuuuuuuuaauuauuuuaaaauuuuuguuccauguguaugaaugguggguggaugugcgcaccuguuucuggugccugaggaugucagaagaggguauuggauccccuggaacuggagcuauagaugguugcgaauuaccguaagguugcugguaaaacugaaccuggguccucuaaaagagcaacaaguacaauaaaccuuccugaggagccguuucuucagccugcaggauguaucugaagagauuaauugaugaagaaauacagcaugggaaaguuuuucugucacugggugaaaagacugcuaugaauuuguuguuaccaacauacuacgugacucugucucuuguaaacaagguagauggcuccugcggacugacacucaaaguugaccucuggcuuacaucugcacgcauacacacacaucuggcuaucauguuagaauuuucuguauguuaucuauuauuucaccuauaauacauauuugcuauauuguaaaucguucuuuuuuaaaauguauuuauuuuuaauuauauguaagcuugugugccucuauguaaguacgaacacauaagugcauuugccagagaaagccagaggugucagaccaccagaaguaagaguuagaaacuuuugugagcugcuuggugugcaugcuggaaaucaaacuugggucuccuggaagaacaacaaaugcucuuaaccccucagccaucucucuaucccugaugauugucuuucaaggagauuuaaaaucaagggugagaagucauguguguacccaucuggccacacugcugauguucuuccugucuaugcagguuuccacuugacauccucuccucggagggcuuuaauauuucugcucuggguccacugcugaagaauccuuucugcagaggaucaaccaggcacuugcucaaacucuacacuaagcuguauccccagccuucuuuuagcuuuuaggucucagaaagucuuuucucucggaacuguggaggguauuuuugcuagguaugaaagucaagcuuucaauacuuuaaaagcuguuguucuuuuuucugggugcauuguuauaaacuguucuaucauuuuuuguucuuuuucucuuuagagaauuguauuuucucuuuaucaccaguuuuaagcaauguaguuguacugugucucuuuuuuuuuaauuuuauuuauuuauugucuguguaugugcaguacaacaugcacauagauguuagaagacaaauuaaaagacuugcuucucuccuuucguuacuguauaagugcuggggucaauucaguucaucaggcuuggcagcaagcaacuuuauacacugagcauccaugucuccagcccuuacucuguguuuugauaggguuuuagauagauagauagauagauagauagauagauagauagauagauagauagguagguagguagguagguagguagguagauagauagauagauagauagauagauagauagauagauagauagauagacagacagacugacugacucuguguuuugauaggguuuuagauagauagauagauacauagauagauacauagauagauacauagauagacucuguuuugauaggguuuuagauagauagauagauagauagauagauagauagauagauagauagauagauagauagauggagucucugauaucgcaggcugaccugauucuccuuuuucucgucccgugugcugggauucuaggaguacaccaccacucccaacuaggcuccuuuaguaauuuuuuuacuggaaacuaggcguuguuggguacaagacauuuuuguauuuuuguaaauacucuugaacuuccaagcuacagccacuaguuucaucugugagcucuugugucauucggugugagcagagcaauauuuuuuguugggcugcuuuuaccccugagugaggugacaaauacugaccugaguucucuacuuuguacccaugauuuaugaggcauuuuuaggcugccucauaggaacacacacaguuuuuggccccucaggaguuuccaucacgguacaugucguuuauuucucuaagacuugggcugauuuucauccucaaguucucuuguauguucuuugggcccagcucugcuccauugaauccacaggcaggacuuuccccgaaucuccagugggguuggucgcucucacucacuuuuuccuuccccccacuacugccccuuuccuucugguacucuguccagguucuggcugcuaugacaucccucacccauccuuuaacuccauccucucagcucaggaacguuaccagagccaccuggaccucuccuuccucuucugcaaucuggagauucccagccuccagaugcagaaggcuugcguuuauauggaaugaaaguagagugagcagagcuaccugucacuagucuaaguguuggaugucuguggcacagugcaaaaccagcagagccugccuuugccugccugccuugcugucgaaacaguuucacugucgguucugaucguccucaaacucagcuccuuugcugguccuuuacccucagcugcucccugaauuauaugucagcccccaaggaaaaaacuguuuauggguuuuucaacugccuauauaaacuguguccuuaucuaugaauggcugaagacauaaaaaggcauucuuucacuguuuccuaccuguggcauuauguccugcaauucagacuagauagcuuagcaucacuuuuuaguccucagcuaaaagacuaaauaagcauggcugagaucuccccauuacccaaaaagaugauuggaugagcaauaccgaguccauuaauaaaaacacaaaugacugcuggguggggugguacacacccuuaaauucagcacucaagaggcaaaggcagguagaucucuguggguuugaaaccagccuggucuacauaaugaguagcaagccagagcuacauaguaaggcccaaugucaaaaacaaaacaauaaaagcuucacacagggaaguggcccagugggcaaagcacuuguccuacgggugugggaaccugaguucaaauugcuagaacccuuguaaugucagucagacauggccauccacucuauaaucccaguauuuauaaagcaagaugggagaaagagacagacucuccaggggcucaccggccagcuagccuggugugugcaguaggaaauaagagaccuauucaaagugaaggguaaggacuaauacccaggguugucccaugaccuucauacaugauauucaugguaguauucguccuaaaugaacacauacauuguacacacacucaaagauuuuaaaagaacauauuaaguuacaaaaagaauuuauccccguaguccuagaacugggugugguccaaaauauggccccuugccucuuuuauaaauaaaguuuuaugagaacacagcccaguccauucuuugauagccucucuggcuaugccagagccuaacgaacgcacuccucccucugcccuuugcagaacaugcuugugaacuccuguuuuauuucacuguucuugaagcaagaaauaaaaaccacaaggccaaaaguuaaagacucaagaaaaagaagaauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugaguuaaauaccuaauaaaaaauggaaaaaaaaaaagaaaaagaagaauaaacuaaacuguacuggaguagaaaauuccagaacacuugcugugagaaaucuacacagcaggauucgccuaaaccaucaccacucgccaccagauagauuuuacauauuuuuuugccaaacuuaaaaauagaaauuugggugucggaagaauauguguugccuuguacggacaguauuuauacaguuaagguuagcaguuguuuuaaggaaacaacacaucacaaaucagaggagugcauuuaaaacccucucuuacauuacuuugugcaguucuccccuguguucagaaagagcuuaucauauuuggauuuugagcagaguaccgacgcuucuguguuaguguccagcauucccauccugaccacucugccagguggaugcuggacucacagacacgggguacugauagcagcaaaguaguuacaacuuguuauaaauauugcccaucugcccuuguuuuauguaguuuacauuaggcuuaguugguuuauucauugggucuuucucuuuaccuucugcuccaguugguauagauacaggauuagcccgguuuugccuugguuuuguugucuuuaguguuuacuuauuuauuagcaugugugagaggucagaagaugguguuagguccccuggaacuggagucauaggcaguugugaccugccauguugguacugggaacugaacccugcuucucuucguaaggacucuuaacuacagggacauugcuccugguuuuuguuuuuuuguggguuuuuuguuguuguuguuguuuuuguuuuuuguuuuuuguuaaagacaaauucuugcguucaaggcuggccuugaacucaagauccuccugccucagggcugggauuaugaccucuuucuuaggguuacuauuguuguggugaaacagcaugaccaaaagcaaguuggacaggaaagaguuuauuuugcuuaagaaguuuccaagucucuguucaucaaaggaagcgagggcaggaaucuggaggugggaacuuaugcagaggccauggaaggaggcugcucauuggauuguaucucauggcuugcucauccuucuuauagaacccaggaccaccagccuagggaugaccacacccaccauggaccagcacaguccucuccccucccacacacccaccuaaaccaguaauuaggagaaugcccuacagacuugccuaccagcagaucuuauagagauauuuucccaagugagguuuuucucggauuacuuuagcuuguguugaguuaacauaaaaacuagccaggacuuuaaaguaaaguaaagaccaaaauccuggacuggggaaaagacuugaagaagauacugagcuugcaagaggaauugugugagcucaucuucuaacaagccugccuggaguacuuacugaugacucugaauuguuuguauugagguaauuuugagccuuucugaggccccaguugaccuuggacucuccuugggcacagggcuugccuugaacuuggggccaguccccugccucugccuccucuuccccuguguugggguuaugggcuugugccaccaugcccaacgagacuuaaauacagaggaucacugcugcuuugggaagacugaccuucauacagucugggcuauauauggaggucugacuccccaaauauguaaguaauaagagacagcuuugaugggaaagacaauucaacagauuucugcaaugccaggaguggauaccauugagaaccaaguagaacugaggaaggaacugaauacagagucccggaaaggcucacaaguaucaguaauaacaccaagagucaguggggcuccagggaagacgguaggcucguaacacuucauuuuauuuuauuuuauuuuauuuuagguuuuaauguuaccagagcagauaauuuauucacaaaacaaaagcaagauagaaauaaguucaugaaaucuaauagugggguugggaaaaugguuuaaugguuaaacgugcuugcugaucuuguagagaacugggugugguucccagcacccauauaggguagcucacaauuccuugaagccacugcacuuuggggggaucucaccuuuucucggguuuguugacagugcacacacacacugaaguauccuaaauggagcuagggagauggcucaguguuuaaggacacaugccacccacccugaugaccggaauuugaugccaggaaccccacaugguggaaggagaaaacuggcgccugcgggcgccaguuuucuucugaugccacaugugcgucuaugcauauccacaagcacacuuuuuuuuuuaaaaaagcaaaaauaaaaaccaaaaguguggagcuagaaagaugggucagcaguuaaaggcauuuguugcucuugcagaggaccuggguucccagaaccaacguaacagcucauagccauuuguaacuacaguucuaggggauucaguucgucuucuccccuccaaggaccagcguguggcgcgugcacaugcagacaaaacaccuguauaccuaaaaauacgccuuuuugucucuaagguuuagaauuauuaaauaauagcaaacccuaaaagaaugagacucggauuagcugucggucucuuaacacugauaguggauguggaaacaacagugauauuuauuaucaguaagugguuaguuuguauaccaggguaaaauacaugguuuuaucgcuauaagaaacacaguuuaauauuccauacacuguucggauguguuccaggaaaacaguagauuaauaaucuacaagggugcugacucgguuguaagcagaacuaguucugguuuauugaaccagaagaggaacuuauugaaaggauauuggauaacucacagggugauugggaagauaaaaccagucuuagggaagaagugggggccaggaaaccugaacaacuacaacccuagcuagcgaagucgagaaaccccauaaggggcucagcaauuugaguuccucugaggcugccuccugggucucuauaacgaucgauccgaucgucaugcugcuguggucaggcuccugcucuugguggcaccaccaggauuaugaccagcaucugguauuuccuaggguucaaguccaagcugggucugugccucgccaccaccuagaucaagggcuuaaaguuugccaacuuguagcacuuuuuugaccaagaaauguuuauaugaccccagguaagugaguauauauaauagguauacaaacuaaccacuuacugauaauaaauuauuuaagaauuauauuucaagccauuuuguguaaccugcaguuuuaccacuuauuaaggacaaaggcaaaugugcauacuaauaaaacagaugugcugcuuauuuuaaagugaacaaugaaaucuugaccugggagaauuccaccucagcgguagagcacaggccuggccugcucagguucuggguucagucccccgauauucagauuucagggcuaagaagcuuaaggaguuaaaucuugcagaucaccacagaaacuaaggcauauucaaccuuuuucacagcagacugauauuuguacuuuaugaucuucaauacugagagcaccagucacauuaauguauaaguaaccggcagaaaaugaauggggcuauuucagaaaugguuggaaauucugucuuguucucagguuuuuaaugaaauugaagucaacucaagccauaguuuuuuuguuuuuugaauucuaagucugcacuccagcaauacacuaaugugauuuuuccuaugcugaggaacaauggcaggaaaauacuaaaaagucuuuguuuuccauaauuaagccacaguguuucugucagcagaaagcuuuguguguauggugaaaacacaguaguuugugaccuacauaaucucagaucugugcuguuuccugggguguguucauugguguuuuucuggagcgacagcaugggaaaugcaagcagugucuucuauguucagaaccaaggcuguggggaaggugucugauacaauaugggugaguacuggcagauuccaugaaauucaucauuucaguguuuaauuuugggcuaacuuuugaugguugcacauucaaaaaccuuugacuacuaccaauguguguguguguguguguguguguguguguguguguguguguguguccuaaaugugauuaugcuagcuuccaugugggguaaagacccucaucuuaagaagcuagauguuaaguacaggcuggccuagguucuaaagaaacuagaauugagaaguggauccguuaacauagggucccagguuccaguaccaagcagauacauaauucuuccaaggcuucaucacugugacagugaaggaagauggcagaacaauagccauguuggggacugggaagcagcccaagggcuaggcagcagauugggagauguagacagaaugaagaguggggauucaguagacuaucuaagguggaggguauaguaaaggcaagaaggaacuggacacacagcaagaacgcacagacguuacgggagcuuuuccuggcaaguuggaaacauccauucaccucagauaaggcaacaacgggucaaagaaaugguuccacccauguccaaccugugagccacugaguuagcuuuuaacuucaagagcaugggcaauuuaucagguacaggcuaaagcaccagggggucuacaacugcaguaguuaugugaaaggaaauacaaacucugcuguacuugacuucaacaugaacaaaauuucaagaaccguggugugcauaaauggccuauuuauccaggagcauauaguguguuuguagggggaaagggaggagaggugaguauugcaccacuggaagacagcacagaauaacaaaacgggcuaaaucaagaauuggcugcauaagcauguuacauagggacaccagcagcaauggugacauugguucuccugggaaggcagccacuguaauugcucugaaacauagaccuuggggcuucuauuuaugucuaaacaacaacguagcagggcuggagagagaguugagcaaauuuguuacucuugcagggaagaccugggucuagcacccauguggagccucacagcuuucuguaacuucuaguuucaggggaucccaaccccccucuucugacuugugugggcacacugcgugcacacagugcucagacauacaugcaagcaaaacacccauaacaugguuaaaauaaaaaacaaacaaacaaaaaaaaaaacaaugugcaggcagggcagguaaugagauggccaauggguacgaaugcauaaugcucuuaaggaggaccugaguuuguuccuuggcucccauguuaggugguuuacaaccaccuauaacuccagcuucagggacaugugacaccuggccugugaggacaccugcacucagauguauauauucccacagaaacaaacacauacgcaacagcaucauuuuucaaauguuuuaaaaagaaaaaugcaacaagaaggaaggcagauguuaguuccugacuaaguggcuucugaacauugugugucagcuuggcagccacuuuuccuuuaggaacucuccuaagaggagaauuggcucccagguuaguccauacauaaaaguuaaagugaaguuucagagucaaaaagaagaaaaaugucugagcuuggguaguaauuguaauucaguaaaaaugguugaccuggggcucuugggucacuguucagggcgccucuuaccccccugccugaagggcuuugguuucucucaguuccucacucacaggcucacacaggaugccgcucugagcugagcucucagcucucacuauaggauuucuggugcauuccuuuugguuugugugcauccuguucaguagcagggaccauugugcccccuccaagauuuggccauuuaugcuggacacgucugggaagagacaaguauuugagaaacaugcuguuugauuugacacagugucucuuuaagcagcccugguggccccacaacucacuccauagaugaggcuaauccccggcucacagagcucuccugccccugccugagugcugggauuaaaagauguucgucaccaugcuucagcugcucuuucugauacacagaugccaaagaaauaccuguuggggucauacuguggaauugcuaguuugaaugucauuaaguuuaauauguggauguggccauuuuaaaaauacaauaaaauguuacaaaaauaagcaugacgucauugccucauuuccuuucauuguaguucacagaaauagccaccaugaacauuugauaaauggaucuuuccuuuaauuauagguucuuuguaugugguccaggcuaacuucauacacacugucuuccagcuuccucuaccuaacuuagcuugccauggucuuuccaagccuuucuccccugugagaaacuuuuguucaaauacauaguuguaugcuccccucugccgcauggaaucauauaucucuuucuauaacucaucuccacaguacuuuuucuguguaguauguggugcuuaaacuccagccagugcacagacagacaguuaugcacgcauacacguuaucucuuagagguugacaacacuaaagcuuugugguaaggaauuggagaaucgauuccuugucuuauuugguauaaauaaacaaauaaaucaauguaaggugggcuugucuuucgccuugcucuggggauccuaagccaaagacuagaccugggcugggcauguuguugcuacacaccuuuaaucccagcucucagaggcagaggcaugaagaucucuacaaauucaaggccaacccugaauuuacagauuacuuagugagguccaggcuauauagugagauccuaucuaaaaaaaauaaauaaauaaaacuucugggccgugauugccauguaaaaucgugcuguggcagcccacacgucgcuauggaagcaggacgcuugucucaagcaucagaaaagucaagguuagccgggcaugguggcacacaccuuuaaucccagcacucgggaggcagaggcaggcagauuucugaguucgaggccagccuggucuacaaagugaguuccaggacagccagggcuauacagagaaaaccuaucucaaaaaaaaccaaacaaacaaaaaaagucaagguugcauagaaucuguacagaucauauuugcuaauuugcucaacacagaaagagcguguuaauaccuauuccacagagucaucacuaacauuuauggagaaauuauuauauaauaguguugaaugcuuaaguaaaauguaguuuguuaauuacuauguuacacaguuaugaggaagucacuacaugcacgcaguaccagguaucacacuccaggacauguugauaaagagugcugguguugcugugauuuguaaaaagacaaagguuagaaguauugcauuaugguggugcgucucuguauauuauauauacuuagauuuacuuagguagaacaucugaagaguuguuguccagguaacuucccagugcuuacguuugagaaaggggccuggggaccgggagcaggagaaacucuugcuuuucccauuuaucuguuuguagugaguaaagugugguuugcauuuauuauggcaggaagagguucggcuuuucugaauggauaagauaguauucaaguuuauuaugaaggcaaugucaagggccuagagggguaacccaguggguaagaacucuuaguauucuugcagaggagugggguuccuagcacccacaucauguggcuuacagucgacugucacuccagguccaggggcuucacuacgcucuucaagcauccaagggcagcuacacacauuugugugcaugcaaauagaugagcgacuaaguaaggcaccggagaaguggcucugcggccgagugcuucuucccccagcagaggacuggaguucaguugccagcacccagauccgguggcucaaaacugcccgugacuccagcuccaguagauucguaucuuucuggccucuguggguaccuacacacauaauucuucaaauguuuuuauauggcaauaucccccaaacuccucaugaaggggagcuaagcccugacgaggcguaccaguucugggcuguggagaauguuuuaaacuucaguccucucacguugaauaagcggugauagcagcugccacguggagaggucauuagacgccauaguauaaugaaaugcaaaguaguuaacgcugcuguaucauaaggcugugucaggaccuuugcuuggccuuucagucuuuccauuugccuaaaguuacagggccugguccccaagccugcugcuucccaugacagucccaagccccaggucucucaccugugcuuucgacugaccuacugugaaucagcggccggccgugggcacuuuacuuauccuuacuggcugaauaugaaggccacuccagaagaaggggcuggauagugagguacagaaaaggguguggaccuuagugcaccucucaugauuaccagucuccaggauuacuuacucagaaccuuaugaacccaguguuuugaguuuuuaacggaagcuucaugauauaggcaugauugauuuaauuauuggccauugacaaccaaccuacucaaccauuaucccucuuucccugucugaagauuggaguuggggcuaaaaucccuaucauggggauucauaucuugaaugcuguugcccagcuggugggguuauuugcuguagggcuacagaaccuuuagaaggugggaccuaggucaguaagggcagacuucugaaggggacagccaucccuaguccuggccacugugcuaugaugcuggcauccuccguauguccgauggcuuacacuccacugugccuuuuccucugugaugggcugaaauuccuaaaaccuugagcucaaauaaacauuuccucccucuauauuucugucaguauucugucacaguagcccaaaaguaauaagccucaacccucuaguaacugccaacauaccaaacucuggucacuagaaaauucuuaaguuuggggaguuguguguaaggacaccgaaugaagaugcaaaacauguuucauauaacaguuucaaccaagaugcucacacugugggcaaaacaaaaccauggcagacggaagagacccaucagcauuucuuggaggcggagaucaccuacacuauuuaaucuagcuuuuuguuuuacuaaguauauaggauucaauuugccauguucagcauugacacaacaaugcccuaucacagaucaaaguuuacgauuugcccacagaguccagacacuauacgcauguucauaucagggacuuaacaggaagcauggcguucauucaagucuaaucagcccucccauucaugaaauagaagaaaggggauacaauaaaccagcagaaagaccuacuuaagaaaguggaacgccauauagugaucacuuuccauagccccuugugucuuccccaggcauggcagauguggacugacuugcuagggaugggaugauugauggagcugcuaauggccuccccaguuggaaacucuagaaaagacaucuugggcugccuuucuuucagagcuuguuuguuuguggugagagccucuaagccucaugauuaauacccuuaagagacugagacaucgcaggccugugcucucucaucuagcauuuguuguacugucugguauuuagaauugaugcuuaguaaccagagucacacauggagacuagcucugguccuugaaguuugagcucagucucuuagcaauaaaccucuggggacuuuguccuuccuuaggccuuucccgaaacacaaauuaaaauggccuagggugauaagguaaaagucacauggaccacagcugcuggccagaggauagaccuuaaggagagcaaagauuugaggccuccgagcucuuccuggauccuggacuguuuugccuuggguagaggagacgguagccugaacucuuuggguugcacuucauggacauaacggggccaaaaugugaugacuuacuaucaaguggucuagccucaaaguaagguuuuccaucuguagcagcuuuccaauugccacaagaagucacacacaaaccuuaccauucuaguuucuaccaggaccugacagcucccgguuggacccuggcccaucuugacuuuacugcugcuugcagcagacuuccaggguuucaacccccaaccuuuuuccuaaagauauuuguauuggcuaaagcaacaaaaagguguggagaagaccaaguauugcuccugaugccugaaccaagucagacucuuuuucucuccaguccuguuuucaagccuaugacuuuugccuguagucccagggaaauccuuagaguugagucaccccuuucucccccagcuuuggccuuauaccgugcaaccuggucacuguggggguggaccgggaggcagcacagcuauuuagcuauaccuagguguguguucacauacacucaagcucucacgggaaaaggcugguucuccagagagagggaacagugcccagauaucucaaaacuacacaacauacuuggauuggacaagagagcagggagcaggaaaugauuuggagaaugcaaauugcugaauugucuuuccugcgcuauuugaugagcccuuugcuuagcccagucgaauagaaaaacuaauguuuaaaacacaugcacacugcauguaauacucaaucuuuuauaaagccaaaguaucauuuuaacauaauacgaacauuuaaugagcuguugguccgguggagauggguugguagguaaaaaagcuugucauuaucuacgauauccugaguguaguagaaucucaacacuggggagcuggagacgaauggauucauggaacucacucacuggccagcuagacuagccuacuguacaaauuugggaccaauaagagucuuuaucuuaaaaaucaagauagauaguacccaaggagcaacaccugaaauuauccuguggcuuccacacacagaaaauucauaggcuguuguuuuguuuuguuuuaaacccaguguguauuugagacuuguagaguauaauguguagguuggggaaaacugauggccaacugcuacugcuauggacuggguuagccaaaaccuuuucauuagcaagccagacagccaccaucuucugauaaguuaccuguaucccauaucauaggcaguuaaucugaaguugcaaaucucacuagaagaagcuuccuaaagggagcuugguacccauuguccugcuaggugucuaguuguggaaacaccuugcgcuaaacacccauaauacucagacauuaaauacuugccaagcacuuagucuucuggcuuggauuauacaucggggaaggaagagacuccuauccuuucugcuuaccuugguuccuaacugcaguucccaguauguagaaucuguuaaagggguuuucaguggagugaaaaauaaguuuaaaacuuucaugaagguuucucacuuuccaaauauuagugcuguugguuguagcucgugaugguguauuugcaauguuuauuuuuucugaugaagggccguguguagccugucacucguuguguuccucugaaucacucaucugaugaauguauauagaaagagugauggaauaccuacagaucccggcucucugccaagcuccaggaugcaaagauaaaugggaacugucugucuuaaaggaaaugagaggcagagaaguaaccauuaaguguuaggauauaagcaaauacagucaguaucugggaaacacaaggagguguaaguauccaaccaggucagaugggggaguccccacuaacgugaacuuacguuccauagugcaugagauguucuuagcaaccagcccugugccgagcacauacauugaaacgguggauaaaugaugaagccagagccgaagaaucacuuuguucaacccuccaaguguagggacggaaucgcugcaggggcagggaauuagugcguuggguuggccuucugaguaagacugugggacaugacaagccacggagugggauagagcaggagaagagaagcacagacggggccacugacagcugucucuccuucugacuacaggcaaagcgaaggcuggaacugggcgagaguggccaucaguaccucucagauggucuaaagacccccaagggcaaaggaagagcugcacuacggagucccgauaguccaaaaaguaaggaugcuuucaucuguuucccuguucuccuuggugugggacucccaacucgcaaagcuuguggcuggaagggugccaaggugugaauaauuuuuggcauguuuucuucuuuacuucuuucugugacuauccaaaaauuaaaaauuaaaaaaaaaugcaauuucuucuggcgccuagcaaaaggcaauagucacuccaguacuugaaugcauuugcauuuugaacuagucagauuuaauuuucccuucccuuaguggacgucacuugagugcaagggcggaggcguguguggcagcgugaugccucuccuaccucacuccccagcucaccacaccguagccuagaaacugggcagagccuagcaugaggaggccugggcucaggccccagcaccacauaaacugacuguggucgcgcacauccauagucccagcauuugggaauuggauggggaaaggucagccucagcuagguggugagcucaaggccagccugggauacaugauaccuuaucucaggaaggagccaaaagagaaagugguaguugcgcuaagucccagcuaauuccuugccucggugaguacugucgucaugucauuugagaaggaaacgaauacgucauaaaaagccaaauaucucuucuguuucugcgcuuagugcaaaagcuaacuuagacuuggcucgucuguccccaugguuucuguuaugcaucuguagucuauguguaagggcuaaaucagaaccucagcgugagcgccugcagaagaauagcacaauacuaaauacugacauugccuuuaaaggacguggggaacuugaacguugggggcuauucuucaucaaaauaagacuuuuucugaaagauggauugacaagggauaacucugcagcccccacuccaaagggcuggugaggucgagucuguuugagacccugucuugaacaaagaugaccuggcucugugaguuuaugcuucuuaaaugagauucccagaggccucagcacuuuuucauccauucaacagauacuuugggacaccuagacccagagaauaggcuaagaggacauagaaacuacugacaacgaguccaagaaaaugccauugccaacauaggaaaucuuuaucaucucuuccuuuucugauaaaagccaccucauagcucucuguaacuuacccccaaacaacgaccagcuuugcuuuagauacuaaucuggcugccgugggaaagagggcuugcuuagcugcgaagaaacccuucauuucuuuaccuuucccccuaucccccacccguucgguuuuuuguuuuucuuuaagcuccaaaaucucccucagaaaaaacgcgguaugauacgucccucggucugcucaccaagaaguucauucagcuccugagccagucuccugaugggguccuggaucugaacaaggcagcagaggugcucaaggugcagaagaggaggauuuacgacaucaccaacgugcuggaaggcauccaccucauuaagaagaagucuaagaacaacguccaguggaugugaguaggagcccacucucuccccgggcaccagccagcuccucggggccuuuaugacugccucaguuuauccgaauuuuagcuuccacguucagacccauacuucuccccuccccucuuccucuuucucccaguuuucucuuucccccucaaaguuguauguagaaagucacggcugaggauugaguuuagugaguggacugcuuaccuugaagucaugaagcccaggggucaguccccagccccacauauaccaagugugguauugaucagccccgaucagaaguucaaagucaucuuccaguacauagagagauugaggccagcccaggauacaugcaaccguauaucaaaaaaguaaaaauaaaaagucuuuuagcacagggucugcauuugauuagcauaaaucaagaagaucguggaacucaguagccccucugcaguuauaaauugagaaggaagcuuugaaucaucacacuugacaucugugcaugcgugugaccugcagaugcacacgugugucucugauacuguaucuuggucaucugugggcgaauauggacaaacucaguuguguaguggauucaucccuaaauuaacacaguuucucugucaaugaaggcaagacuucaaugucuggguuuuuucugcagagaugugugcacuaaugugucuaauucugcaugauaauaucauuugugaaucauggacagagccaggcauuuuauaaguacagcacugaacuauuaaaucauguuaaaagagccaaaacuaguuaggagauguuuugaaaacaauauaauuuacgggcuggcaagguggcucaggcaguggaaggguggccucaaaauccugacaacccagaaucaaucccugaagcauacauuaagguggaaggagagggccaguuguccuuuggccucugcacucccaacauggcacgguauguccacacucagaauaagugggggaaaaaugucuaaauacaguucaagggcuaaggauguaaccuaguggcagaaaacacuugcccgguaugcacuaaagacagcccugaugcguucaguccccauuguuauuaaagaguggauuucuauuuauaauuaagcugguagcuguguguguuuggaguuguggacagcugggggacucacuuugaccugugccuuagagaaaccuguuaacuacugcucuuucuuacagaugccuagcacaccuguccguuugccccggggggugcaugcauuaggugauggggguggaggagaccagguggcugcuuuuuuuuuucccccucagaauuugagacucugaacaauuagaccuuuuaaaaaaaaagaaaaaggaaaagaaagacccugaaaauaacuuuucacucgacuucugugauaugugaaagguacaugacuguauuuaugaaaacuguauuuacaaagcuguacucuugacacucgacucacaaacaacacgaugugggugagggggguuauugacugauuucccccacucccuaccucccccuccuacucuuuagcuccuguaaagcgccauaaucuguguuuggguucuaggggcugcagucugucugaggaugggggcaugcuggcccagugucaaggccuguccaaagaagugacugagcucagucaggaagagaagaaauuagaugagcugauccaaagcuguacccuggaccucaaacuguuaaccgaggauucagagaaucaaagauauccuuugugcugcugguggugguuagagccuucuguacuguuugcagagcugacagacuaacuuguucaugauguagauagauauuacucuggcaugguacacacuaucagugugugugugugugugugugugugugugugugugugugugugugugugugugugugagauaaaguacuuuuagacuaugugguaucauuaucaguguugauagccaggugagaacaguuuuucaaagcaugguauguaugguuggaaaaucugaauacacucacaucauaagaacacacuauuaaaagaugucauaaggugucuggaucaguauugaugacagcauccagcagguuugaccuuggcuucccagaguuuuaauguggguuagcugucauuguuggaguucucgaccuuuaucuucuuucuuucuucuuuucuuuucuuuucuuuucuuuucuuuucuuuucuuucuuuccuucuuucuuucuuucuuucuuucuuucuuucuuucuuucuuucuuuuguagcauuuggaguuugcugugucuggguggacugggacugccugcaauccugucaauagggaaacugaguccugagugcacagccaaucuggcuacaaccgcagggcccuaucucaagaaaagaaaaaaagaaaaaaaaaaaaacaaaggagaaaugauacuuuucaaagucagguguguuguugcacauuugugacagcaauauuugaaagauaaagacagaauuaucagggguucaaagacagccugggcacuauaaaguuuaaaguucaucuagggugcaugagcacuugucaagcaaagcguaaaagucaagaguucagguugugugugucugccuagggaguuugaggccagaguagaaaucuuguuuuuaaagaaagaaaaagcaagauguggagguaugugccuuuaaugccaguauuugggaugcagguagaguuccagaccagcccuucuacauaaugaguuccagacuagcuacaacuucauagugaguauguccuguccaccuuaucucaaaaaauuaaaauguuaagaguaaaagagccuggugugguggugcagagacagacagaucuuuguaaauuugaggccaaccugaucuccauagcaaguuccaggccagccagggcuacaccaugagaucugucucugaauacauagaugaaucauagguggcucaguagguaaaggugcuugccuccaagccauaccugagucugguuccugaauccaggugauaguaggagagaagugacuccugcaaggcucccugaccucagaacucauacugcacgugcacugugcacacuguggcgcccauucacacacuggacagauagauagauagauagauagauagauagauagauagauagauagauagauagauagauaacuagcuuuuuuuuuuaagaaagaaaucaacaguggggcuuuuuuaguucaucguuggauuggagcucuguuuuggaaaggcugugugguuacacaugauuggcagcuguccugagcauggggcuuggggugcucucgacuuuuucugguaccuuuguuauaaaacaaaaacaaacaaacaaaaacaguuuucuugaaaccacuaaccaagaaacagaugucagagggagcacuuuuaaguuuguaacuuagaaaauguauuuaugaaauucaucucgauccuccguucagcucccagucugcugcagcuuguucacagcuguguugauucugcucccugcagcuuguugaguaauuguaggugaguucuagucuacuaagcucgugucacauagcuuuuugacagugggcucaagcucagaaaccugauggucagcuuauaaaaacaaacaagcagaacgcagaaccauccagaguuccggaaaugcucccauuggccuccuuggugggcuaagugguggcugaaagcccagaauccugagauuugaagaagagaguccaguacaggcaaacaccgaagugugccacggauuuauccauuuguucauauuuucaaagcugaccagucagaagguggcaggccgaucucugcauuugaagccagccuggucaacauagcaaguuccaggccagccaaagcuacauagagagaccccauguuucaaaaaacaaaccaaaaauaaauaacuauaagaguucugaccuccacagucaucaggcacgcacauggugcauauaccuaaaugcagucaaaguacucaaacacuugggaaaaaaaaguuuuguuuuguuuuaagcuuacuaaagggcugguaagaugacucucaguggguaaaagugcuucuugcugcacaagcuuggcuggcguccugaguuugaucuauggaacccauggugggaggagagaagcugucaguuuacugccacacuugcuuugaugaaugugcucgugugcauacacacacaaagacaggaaguaauuuuuaaaaagguggcuagaaacacauguuaugucaccuguguuccuccaugucaauuagcaagagaacaccuugagccuguugucucuagcugaguuuuugugagugcguuugucagccaguuaaguagcaugcucuuucgugacauccuuuuaggcuuagcuuccaggacaccgacaggaauuguuugguacuugaaaguaacuacggagagucgugaaauguuaauuuauucuuuuuagcuaagucauuguaucuuaaauucauucaguugcggagcaccugggagcugcucaccuccuugggaacccugaaauguucuagugauaauaauaacaaggauaauuuuucuaacggaaauaacgauacucugaucucuaggcgcuaugcagucacaccagcccaggugcacccgcguaaacaggcugucugcccgagcaagcaguaggcuccauucuuccccugguguauuugcuccuuauucauucauuugguggcugcuggcacuugcuaauagcaagcagaaguagcugccgucucagauuuugauuagcagaucuuaccucccccaccccacugcaaauuaggaccaugugucaaucaguuugauugacagggcacuucgauggaguucacggacuaccaguacucaagauuggcacgauaaaguauagguuucuuuuagucuuaagcaucaaccagaaaggacaagggccaugaagaauccguuuaccuggugauccaaaagggaaggcauaccuauucuaacucgugaaaccauggguaacugucuaugucuguuacguugugcucaugauagcuacgucuguggcaacuugauagaagauuuccuuaacgcuucuuacguuagcuuauguuacauaucaagauauucgaaaaauuaguggccuuaaagaccaaacuguuauaguugugaaagccccuccagaaacgagacuugaagugccugacucaauagagguaaggagacagugacgccggccauccauagagaacgcuccagaacgccugaacgcaagcgucacugaccccucccaagaacuugcuaauuccucuucauuuauuuccauaaccuaaaguuuaaaaggguucaaaauuucccuguuuauugaaugcccaaaacgucugguuucaauuuagagggguguucgggucacagcaggcuuuggugcccuguuuucucuucaacuuuccuuuuucacaauuuguuaucugguggcugugaucaguuugaaccacuugagaauuuuuauuuugauugccuuguguacggguguccccacuauggauuuuagaaguagcucucugaccuagcacauuuuuaggaauucuuuaaaaacauuuguagcauguuuacuuugagaaaauuaaacgggaccuugggguaaucaauagccaagaacguuguaagaaaguaggacgggcguccuuguaauugcuuucagguguacuuugaugaaaucagccucggcugcaauuauaagauaaaggagcuauagugaaaagaaaauaccuagaauauuaaaagauaauaccuaaaauauugaaaacauuaaauuuacaagguaaacuucauaccuuauacaguuacaacguuaugaccuagaugaagagggccucuaaauauucguuugcugagcaagcugaagagauggcucagugguuauagcacugacuccuauuccagaagacccgaguuccauucccagcauucauguauagcucauaaggaccuauaacuccagcuccagaagaugcagugcccucugggccucuggccaacagccacacacaggaaucuauauucacacagacguagaagcaugccuuuaaauaaugcacuggagagguggcuuagugguuaagaacacuuguugcucugcgagaggacccugguucaauucccagcagccacguggcaacgucgguaacagcuugucggguacccaggcgugcacauggguguaaagauguacgugcagggaaaacacacaaacacauaaaauaagaauaguuuuuuuaaaauaauaguaacaaaauuaagucuuggacuggagagaugcuuagugauuaagagcauuggcugccccuccagaggaccugggugauucccagcacccacacagcagcucacagccaucuauaauuccauucucagagggaccaccaaaaggcauacuugcugaugcauaaggaugcguucaggcaaagcacaaguacacaugaaacuaaaugaauaauucuuuuuuuuaaauccacuuauaauccaauuauuuaaaaaugaaaaaaaauauuuuuuuaaaaaugugcugggcaguggugacacacgccuuugauccuagcacuugggagggagggacaggugaaucucugaguucaaauccaaccuugucuacaaagugaguucgaggaaagccaauaugcuuuauuuauucucuuacucacuaaagcuccuggcacuuuaaaauacuagguauaaguugguuauuagaguuuauaaauuggguauuagaaaaucuuacuaugagaaguuaauagaaaaaaguuguuuggaacauuuaacagaccuuuaaauaauuuguaggaaaauaauacagcuaaagaagacguggacacccaccccucaaauuauuucucuagcaagagucaacaaacuucuuaaagauccagguuguaguugucuuugguuuugcaagcaacauaauuucuguuuagauuauucaaguaauaaacucuacuacauguuacuauguaagaugaaaacagccagagggcaauaugaaaauaggcagcaugagaauggccacagacucucugucccaauaaaacuuuauuuacaaagcuggaugcuggcuuggauuuggccuucagacuauaguuguuugcuggccccugcucugggagaaggucaguacugacagacaaaggguaggggagcaaaaugaacaaugaucaucgccccuccacuucaguuucaggugagaugugcuuugguuuucauuucuaagugaacuugaucucuuucuugguucuagagccuacaaauccauuuggcaaguacccaagggcccauugagguuuacuuguguccagaagagacggaaacacacagacccaugaaaacaaauaaccaagaccacaaugggaauauccccaagcccacuuccaaagguaaacagauuucacucugagacacgguguuuaaaaaggaaggcauggagaaggguuuuccuucaggaccucauggcugugucuuaaccaaaugcuuggguccacuagaccgaugccauuauugcuaagagucacguguaacccaugaaacuuuccagaguaaccaaagugcugggcagagccugcaagugggccuggaauuuaugggugacacuagcugcuccaucauccaccauguuaaaggccuggugugagggugacaugcuuguccuguaggagucaggaaggugacuccaaguccauucugaacuugccgcuggguccuggguaugcaucaguugaccaugaccugcaccuuuuaaagccuuugucuuguauggaggggacggggagagacguuucauguuguuggaagaguuuucugaggcauucugaucaauuuuagacuaaaauaaugaucuugguccaaacggucccucacccccgaugaagaugcugcaggcucuugaaagcagaaaacuguuuccuuggcguacuggacgauggcuguagacagucuugggucucagccaugcuucagcagacaucuuggaugaugcuccugcagucauuagggauggaauugagaagucaagccuuggucagagucuugaccucaucuuccucuccagagcaguaaggagaggaucuaugcgaucagaaagcagcagggacauagcccacuucuccuuuccuccagcugaagaaaagcucuugggaacuucagcuuggauuuaaagacacagaaaaccuuucuuuaaaaaaaaaauaaaaaaagguucaacugugacuagacuagaacaaaacaaagugaugucauucuuugugccuguuagccuaauggugaucuguguccucccguagccccagugagcugaggggcagcagaauauacuuucuucccgaaaacaaguaggguguuuguuuguuuguuuauuuguuuguuuguuuucuccuaacuuugacucuccuccccacccccuuacagacuuggcuucuaacaacucaggacauagugacugcucgguuucuacagcaaaccucucuccucuggccuccccagccaaccuuuuacagcagacugaggaccaaaucccguccaaccuugaaggaccuuuugugaacuuacugccuccccugcuccaagaggacuaccugcugagccugggggaggaagagggcaucagugaccucuucgaugccuaugauuuggaaaagcugccucugguggaggacuucauguguaguugauugggcuuuguacaaacuguccuuauaaaccaauauuuuuuuaucacggaaucagaaacguguaucgcaguguugucccuuccuaccuucuuccuccaagaguaucaugaaguaaacuucagaacaaagcugacauuuugaugaauuaauuuuuuuuuucuaagcgcacaguugcaggcucccuugggaaagcccugccuggucccaggcucccaaaucuuccugaugagucagcaagugagaagaugugcaaucaggugucucucaccuguccuucccuccccuccuuccucuccuuuccuugcggacuggcuugcugugccuaacggaugggcuguugacuggguccggccgccuggcccguuggaaacagcgcccucccuuaacagcaguucaagccgugccuucucuugcagaaugcaugucuuugugagucugcuaccacggaauggaauucugccacaaaugcaagcuugaagucaugcaaaggaaugacacggauuucuccagcucuuaggaauauuuaaauuacucucauaauucaguguaagcuaugggccgcuagugucccacuaggaggcggcaagagccuccacagccuuuuuggaugaagaacuuguuugcaaguacucguugcagauacagagacugguagaguucugcugcucgaagcuguuguggauuucccugucuccauaccccacuuccacugcccccauccugcguauuugugaguuuucccgguugauuacuugugacuuaggaguuccuuguggguuguuuuagaaguuuuuauuuuucuagcugccauugaagcauuccuguggcgcccaucacuauuucaauugaauuguuuaccuuaaagcgaguuuugcaaauucuuauuccuuuagcagagggagagcaccucuacugauaaaaagcaucuaaccccgugugaccuaagguccaccaaccagccucugcgagaagcauccucugucuugccuccuuucccaggaggggagcuuggagcgagaacagcuccggggcuugcugacucgagugguccacagugaggaccucgggccagauacagcugucccguggagcagcaggcauggauccccuccauccuugggcuucccgggccccugcgaccggggaaagggcucuaaugccacacucagggagaccacuucucaggaugcggucagguggagaggcccuagggagaaagacaucccauggugugaguggcauucuaucagggacacuucccuaaguaggagcgaggagcucccacugugucuggggguuggacuaguucuagccagaacccauucuccgaauccacugugagugggugaguuuggacuaagggaggucaggagacgggaaaugcacugauagaaugccagggcgacucccuuguuacuccucaggaauggugucccaaacuggaggcuuugugucagcaaggacccuuccaguuaacuuccaagaauagcguucccacuggcagguggcaagggccaucuuguccugguguugaauauggcauaguaccucaaauccauuccuuggaugcuaagggcugcggaaaugaguuagucacgaaaacuaaccuccagcugagcaguuugaaacacuacgugccuggccuucccgggaggcacguaguaggcacucaacucauacacguuugaucgaguugaaaauaucccuugggaaaaccuuuuacugaaaccacaagaacccuggccaguuuacucuagauagauuuccacaauaugcaaagugguggugguggggggaggguggagacagaagacaccggcacuuuaaacucuguguguggguaugcgugguguauguuugggaagaaaaaacaaaggugcagacuaucuuccucucucuucagccuccagccccggccuccuccccucacacacucuggacuugguaccgaauaaucccgugugguccuagcugaagcacugggguggaggagggagggggagcuucguguuaagugccuacuggaaaugcacugugggguuuuuuccuguaugggaaaccguuuaugccaagcuuucccccaaugcccuauauuuaucucaucugguuagcugccucugcuucuggcuuuguguaauucucuuugccagcugcaucgagcuggguuucuguccccaaagucuaaugacuaaacucaccuggcucuagguuguuguguguuugguugacuuuucuuguugaaacuauucguauugugaugccguauuuauuguuuuaagaaacgaaaaggaauacuaauaagucuucaagcguucucucaaugcauaauaagacuuucuccaguuaaggggcuuaacuggcguacacagugugagacauccaugcucuauucuguuugcauuuuaggcauuuucuuugcucguaguaucuggcacacaaaguagaugaguacuacaguauuuuuguuacuuuaaguccugagaugcagguucccugguaccauugaguugcugcuacuaaaagcucacaugcggaauggcugaaaguuacacaugugcgaaugaagacggcgugagccucagaacuaaaacuguauaaagggcaacacaugagcugucaaacaguguuaggcguguguuuguguacauagccguuuuauuuaagucgauacaguccgcucacauugccauuauuuaccagguuuguacagagauagcaauucauuuguaaacacugccagaauauuuucuagcugguuuguaauuuuuuuaagaccgucgccuuggguuuuuguguuuuguuucuguuguuuucgccugugacucucguuugccuuuuuuuuuuucugucguacauguagcucugucuguaaauagaaucgcaguauuuaaagcuuuagcuuucaggaaaaacgaaguaagaauccaagcgugugcaugacagguugugugugugagaagggaucugaggaagaugccuugcggaggaggcugggugacaguuggcagggugugggaaugucuuuccuacggggugcaggcuuuuguaaaaaaggaaguguuucucccaacacugggaguaggcaaacuacuaaucaguuuagcuuuguguuguaugcuaguuugaaauaaauaaauaaauaaauaaauaauguaauauaauguaaaaauagacaaacaaacaaacaaaagcuuuuaugauggauuuuguaaauagauuuguuacagggugaccuguuccagcugugaucuuaccacuucaaauggauguaauuugaauaaauuuuguaugguaaagggucaauaaaaugauuuuuuuuaagaguucag

SEQ ID NO: 12500 - RNA, 6373 nt, Mus musculus
cggcggggagggcgcggcgcgggcggcucgaggcuggauuccgcccgcgcccgcucccucgcucgcuugcucacucgcucgcgcccucccuccuucucucccagcccccucccaccgaggcccaccccacccaccaccccuggcgcagggacugcuggaaccuggcugcgcgcacugucguuuucagacagacucugcgggcuccgacccgagccuuagaaaccggccucgaaucgggacuggggcccgggccggccgggcagcugaggccggagcagcaggagcgcguggcggagccccgagccccgaacccggucccgcagccuggagaggucgauggagcucgaacggcgucgcugugggcgcgggcagcccuggggggcagccgcuuaggcgccacucucuuguccccaacaggucgcagccugggcggccgggagcucccagccccggccccuggagcgcccguugcgguccccaccuccauggacgccuucaagggaggcaugagccuggagaggcuaccggaggggcugcggccaccgccaccaccaccgcacgacauggggcccagcuuccaccuggcccgcgccgccgacccccgggagccgcuggagaacuccgccagcgaaucguccgacgcugaucugccagguaaacgcggcucccccaacccgcggcgggcauccagccuccgcgcacaccgggcggcuuggcacgcagccggguccccucugcgucucugcagcgaggagcuuucuuuuuccucccuggucuuaaccugacgaugaacacggaaauuuacacgcgcguucgcacgcacacgcgaagucacuuccaaacagucccccacacgccaagcccugagugggacuggcagccccucuggagcaggagcagauagcacgcgggagaaaaaaguugaguuuucccuaacugguugcugaggagucgcuggggcucagggcgagaagcagaugugcagggaguagaagggguggccagacaaagugcccaaagagacaccuugacagauggaggaaagaauccuaaaagaagagguggggucacagagcaggcuagaagagagggguccguaaagccgagcucgagcucuggggacagcgagagccagccagcuaggaggcgcggccugacucccggcagagccggcagaacccugcugcagcggggauccuggcccacguggacaccucagcccagagccaccagggguccagccaggguggguucucgacuccacaaaucccccaguugucuuuuaaaaaacaaaacaaaacaaaacaaccccgaucucuugagcugggcccgagauuggguggcuucggccauguccguuuccaggccuguccugucuuggagcggcugugcacgggaggggggucccaaccccaaauagucacagaucuccaggcugccugggacagccaucccgggcccugggcaucucuuccacguuuauuuaaucgguauuuguuucuguuuugcaucucuaagugacuuuuuuccaaccucuguuugcuugguuagaaaacaaagcucugaguguacuuuuguuuuuagaaguuuuaagcgugguguuugcuuaaaaaaaaaaaaccuguagagauugauuuucaaaucaaaucuacagggauaaauuaacaauuuuaacuguaugcuuccuuugacacaauucacuaggaguauuucucugaaauuuaaaagaaccuacaugccacaaguuacuuggagagauuuuuuaaaagucaauucaaaauggcgcauuucuuugagauuccccccccccccaucaaaauccauucguagcaguuuuauuuugugaauuuaaaucaucucgcuguaauguauuuaucuaggguuuggaaaguaucucucccaguguuugugugagggaaucuaaaauuuaccugcagugaugcauagauucuuuuucccagagaaauggccaucugacuggaguuuauacacauuuggcuguguguuuaguuuagggguguguucacaggaacgguuuugacuucuugaucuacauuugcuccgguucugccucccuggcucugaggguuugugcaccuuucuguuucuagggagagagcucugagcuuuucuagggcuccguuuugguuuguaguuccuuugcguuauguuugaaugcuauugacuacugugugcaucuugaguagcuuuaaagagacagagaggcccgggucacuuagacagaauaugucugucuaggcugcaaauggaggguuuucuagaccucagaauccgaggccgguaaggcugggauccaagcuaaguugcggcucugacacagcccuggcaagaacaacauuccaggcgacuacauggcucuuaccccacagauaugcuagcuucagcuggaaaguuuugaugcccguucaggaaagcugagguguccgcucagauuuagaccuucaagagucucagcagggccgcagccagcgagcugcagaagcaggcccugccuagcugggaacccaggcccagauguggcucccgggcucuuugcuguggcacgccagaucuaggggugcuuacugagaaccggcacccggcccuuccuuuccagcggggaaacaguucccagggccccuggauggagggagggaagccaccgcugacggcaggcgcuucgguggagccgggaccgggcgcgauaguguuagcccgaggugacucgcgcccauuccuaccugcugcagacaaggagcgcgguggggaagccaaggggccagaggaugguggcgcgggcagugcuggcugcggcggcggugcagaggacccagcuaagaagaagaaacagcggcggcaacgcacucacuucacaagccagcaguugcaagagcuggaggccacguuccaaaggaaccgcuaccccgacaugagcaugagagaggagaucgcgguguggaccaaccucacugaaccgcgagugcgggugagcguggggcgcgugcagagggcuaccggcuggcacucaguagcuuagacuuacaacucugaccucgcggaccuugcuucguaggagaccccacuuuaggccccagccagccacccacgucagccaggucccugggcuacugcuuucuuagcccuuuuaccugucccacaggagcuacugcaagccccugucggaagacccugucccugcccugaacucugucagaauuacucagagccggagauugggcagaggauucucugccgcuaaggaccucgggagcuuuaagccuucauccccuggaaaacgaaagggaaagacaggucgugccuggcugccucagagaggccugaaaggugcuugaguugggguaucucaaacuucuuggaacugugaucucauucugaauuucccuucuccaaacuguuuuuggaauauucuccaucuuuucuggccagucagccagguacuagcuggaccuuugccuaaugcccuuucccacuguaggucuggggucauguggagcgggacgcugauagugaguggcccuuccacuacacuuuacagauguaaggucccagacccaaggccacacuguauucuggcaccuuccacaguucccagcaaaugcuacccgcuccuucaggagaaguaaggaaaucauuucuucccugggugggcaaauauuuaaucagacacugggagcacuucucaagccagaccaaagucccaccugccucguggagccccugccauaagcccaaccuucagcccuccccagugaggcugguccgacccagugggagccuggaugcagcagaccuucacccuguaauucggagcucacuaauccugcccagguuuaugggaguggggauggugugggguuggguagauagaaucagggccugggaaaggcugggguacagggauccuggccuggagaaugagcuaggaggucgggggccaauguugggaagauaggggaagucggggaagacguggucagggagagaaaagugguccuuaccaaaguuuuuaggagaaaacagagguggagauuagagggaaacuaauaaacuuacagaaauuaaauauuugcagagaaacauauuuggauuauauuuaggcagcaggaaagaaauuaaauauuuaagggaagcaaagagguuaggcauuuagaaaaagaaaggaucgacuauuuaagggaaacagugagggucagauaucuguaaagaagggauaaacuaaauauuuagaaaagaauaaaauggggacaagaaauaaagaaaaaaaccagacuggaguuuagauagucaagaaguggacaaaaauuuacauuuugggaggagaaaaauuauuaaauguaauaaaugccgaugaaaacaaaauaguugaacaacgaaacucgucugaaaaaucggagauggucaguuuugaggaagaaaaauacuuuuuguguuugaaggagacgaaaaagauugaacuacuaagaggguggugguaccccauuuggagagagauggcagaaagaagacagguugggagggagaaaagaaaacgaauauuuguucaaacaaaagagaauccgagucagaaaaagaaaauaaauuuaacuuggggaagaggauaaaaaaaagcaggggggggugugggggaagaggagagggcucguauuuucuggagacgcgaagggaaccauuacagaaaaucucggcagaggccgaagaaaauacgggguguuaggagaggaggcugcagaguugggggugaggacccuuccuggccaccgcggcccugacguuucucccgcuggcuucuccaggucugguucaagaaccggcgagccaaauggcgcaagcgggagcggaaccagcaguuggaccugugcaagggcggcuaugugccgcaguucagcggccuggugcagcccuacgaggacguguacgcugccggcuacuccuacaacaacugggcggccaagagccuggccccggcgccgcugucuaccaagagcuuuaccuucuucaacuccaugagcccgcucuccucucaauccauguucucggcccccagcuccaucucuuccaugaccaugccguccagcaugggcccgggcgccgugcccggcaugcccaacucgggccucaacaacaucaacaaccucaccggcuccucgcucaacucggccaugucgccgggcgccugccccuacggcaccccagccucgcccuacagcgucuaccgggacacgugcaacucgagccuugccagccugcggcucaaguccaagcagcacucgucguuuggcuauggcggucugcaggguccggcgucggggcucaacgcuugccaguacaacagcugaccgccccgccugguccccggggccgccggccagcaaggcucacagaagggagcgcgcgggagcacgcggggcgcucgcagcuccucggaccucaccucugcgcagccccuuccuccccaccccgccuccagguugguuuuguguuugcuuuuuccagacccccgcucugucccccaaugaaugaaaagaaaagaaagcaagccaagggagggggucggguggggaagaaagaaaaaaaaagaaaaaaaaaaaagacgucggagaaaaaugcuggagguggggguaaguugcaaugucccuggcgauggcgcagauggugcguucaaacccgggaucccagcuguccacuacaccaaugggacauggcggggagaagccaguguucggagaagaugccgcgcguccccgccggagcgccucaacccgugaacugaauguagggaaccuggaggcccugggaucguucacccggucaagaaccgaggcgcccucuccuagcccgacccguccgagugcacgcgggcgcggaucacugcuggaguuuacgccuggcugaggauggcugcgucgccgaggaucuggcguuugcgcuggauuagccuaaggucccgggaugccaggaagagcccagcagcacugagcucuggagccgcacacuugaggccacugagccgcagcuggccgaggccagccagcagcaggaggagaagggcucagcucugaguuccccagccccaagcuuagccgcuagcccggcccucugcuccacucuggguccaggagguggcccagcgaacagcccccuucuccacuguccgccugcccgugcaagagucgagccaggagagcgaggggccacagccccagggcccccgcccacuuugcacacccgcucuccggcccgcgcccguuuacagcgucccuguguaugucggacugacuguauagaauuauaaaucugucuauaucaacuuguccauguacgucuauuaaaaccauagucggagcgugcuaag

SEQ ID NO: 12501 - RNA, 2962 nt, Mus musculus
agccgggcuccgcggauccgcuccccaagcuccgggucucggagcagagaaacgcuccgaguuucgggguccucccugcgccuggcgcccagaacuucccggagcgcggcccagaccgggguagagggggaggggaccaagcguccuggccgcgggaaggcgggaugccagagcugcgaagugcuacgcgccgcugagccgggaaccgaggagccgccggccgcacgacugucugcaggcgccuagcaccaugcacccccggcgccgcgcgcuccugcagcuucgccgcguccccccggaacggcacugagcgccuccaaccgucuaccggacccggaccugcgucgccgcgcuucucagggagccccggccgcggugccggagcgaacacccgccuuuaccagccgcggggccgccggcauggauggaugaggacgcccaugccagaagugcgcggaacucggacaaacuuuuccagcggccccgcggccgccacccgagccucgucuccgcuccgcaccgcguccggcggccgcugcugcccgcgaugcuagccgcgcugcugggcggcgccggggcccgcacggggaccuugccgggcgccuugcugugccugauggcgcugcugcagcugcugugcucggcaccgcggggcucggggcuagcgcacggccgccgccucaucugcuggcaggcgcugcugcagugucagggcgagcccgacugcagcuacgccuacagccaguacgccgaggcuugugcgccggugcuagcgcagcgcggcggggcugaugcuccggggcccgccggcgccuuccccgccucggccgcguccucgccgcgcuggcgcugcccgagccacugcaucucggcgcuuauccagcucaaccacacgcgccgcgggcccgcgcuggaggacugcgacugcgcgcaggacgaacacugcagguccaccaagcgcgccaucgagcccugucugccgcgcaccagcagcgugggcccgggcgcgggagcgggcucggucaugggcugcacugaggcccggcggcgcugcgaccgggacagccgcugcaaccuggcgcucagccgcuaccuggccuacugcggcaagcuuuucaacgggcugcgcugcacagacgagugccgcgcggucaucgaggacaugcuggccgugcccaaggcggcgcugcucaacgacugcgugugcgaugggcuggagcggcccaucugcgaaucggucaaagagaacauggcccgccugugcuucggcccagaugcgagcaacgguccgggcagcagcggcucggacgggggccuggacgacuacuacgacgaagaauaugacgacgagcagcgcgcuggggccgcgggcggcgagcaaccccuggacgacgacgacggccuugcgcgcccgggcggcggcgcugcugcggcgggcggccgcggagacuugccccacggucccgggcgcaggagcagcagcagcggcaguggaggccacugggcgaaucgaagcgccuggaccccguuugccuguuugcugcugcuguugcuccugcugcucgggucacacuuguagcuccugcgccccugcugcaggcugcuccaggccgguaugcacgacccagcugguucccgagcagggcaccuguggcucggagaccggagauggucgggaacacugacccacacucuuccuggguggacagggcccagcucguaccgcagccaacauguucggcccucuucugugcgguuuuccaggcugcagagauaaccggcugaucuauacugccagcucuaaucugcagaauucgggacacccugcaaaagcaaaggaggccuagacucagagugcugaacggugggggucuuucaaguuccaauggacuuggagaagggauguugagggaauuagguuugcaaaggggccggguuuuuauuugucuguuuguuuuguuuuuaaacuguuuuccggugagggaacacauaguacugguaacgacuuaaauugcuugugaccacugagaaacacagcaaucguaaguaaauagaaaaguuccccuuaccgauucauuccugugcucuugguguaucuauccaucgguaaugcucaguguggagcuggcgauugccuuugggggggggaggggcuuccccgaaauuacaacugcauuauauuccuaacccuucaccuuuaauuuuccugccaccauucugaucccucugcaccacgugucuuagaauuaaggauccaaaagaagaaaaaaaguuaccaugguguugaacaaugcauguuuuuuauccuaaagcucgguacugccaucuaggaaaaccucuaugauguuuguucuguuguccuuuuuuuuuuuucccuccaccaagaaauucuaaauuugaauaugcagagauugaauauuaccucugccccuaucagggucuuccacccugguacgucguauauaaacuguauuaaaacugggguuucuuaccaguugcuguacuuuguauauagaauuuuuuauaaauuguaugcuucagaaaauaauuuauuuuuaaaaaaagaaauuaaaaguuuuaaaucugcaucauuguuguaucuccccuauccaagaaauguauagaauacauuggucaugaggaauccacuccugcagcccauccaagaaauguauagaauacauugcucaccaggaacccgcucccgcagcccauuuugaaaugugcccuguguagaagaauguacaguguauuuuacagauuugaaguaacguucuuauuuucaagagaauuuauggacauuguagaaauguauaaaugcauuuccaaacugccuuaaacauuguauuuuuauagacaucauuuuuuuaaaucccguguuuaaaaaaaaaaaacuaugacuuuguguauuuuugguuguuuuauuaaaaaugcacacaccaguaaagaguuuaaacagugu

SEQ ID NO: 12502 - RNA, 82445 nt, Mus musculus
ggcccuucuuuuugugaaugaagcuccacggaacaucccuccuggggguccccgggagccgcggcccgcugagcucggacgccacggcagcagcgucccagggagcgcgcgcuuugcuccagccaccggccagcgcuguggggcccccgggucgcgggcggcgggagacgcagcgcgaggacccgggccggguugccgggccauggucgcgguccccugacgggccgcgaccgccuccaugaagcguaagagcgagcggcgcucggcuugggccaccgcgccccccugcucacgccgcagcucguccuccucucccggcgugaagaagagccgcagcuccacgccgcaggagcugcaccgccuggagcagcaggacgaccuguaccuggacaucacgggugagccccgccacacccccacgaggcucgcgccuccucgagccucuagucgcccgugcgcccgcgguagcaacuuuaccggagaugggccgaggggucacuccugcaagugaguccggccucgggagcggggcggcucugcccucgaacccaccucaucgcgggaugagccggcgcgguuguucccacgcgaguccgagccucugcugagucccgcuggucuuugcugucccgagggcccaaagccucgcugagccuuagcaacgcgugggauccggcccgagcccccggccguccgacaccccccccccgccccccacgcugucgcgcccucucaggccuccugagggaucuuugcccucccucucgugccuccagaaaggugucacguugauggcguuugaaccaccaagcgugcuaagagcucagaggugucacuuuugagaaauccccgccagccggagcggguagaauagccgcuuucgagggugauuuuuuuucuuggugucucaguucuugaagacgaaagaaauccguuuuggcagccgcucgguuugcugggguugauagagaagccagagcuuugccuucguuguacugauguacguggaaaagcguugucagcugcauagcugccugcgcgguugaaggaaggugccgcguuuucuggggcggaugguguccaccucuuggugggguuuuuagaaaagguuuccaagacuugaacuuggacuuugcuaggugggcucucgauuggugacauuuauuuauuuaggaaguguuuagacaaacaaauuuaguagaaaguauauucuagauuaaugggcaacuagaaaguaagaccgguuuuuaaaggaagcugagaggagaggaaaggguuuuuuuuuuuagcguuugaaggaggaagacgaaggacuuguuuuaacuauagccccugacuagugucugcccaggucuaccggugugugacccugaaggaggagacacccuugcccggguuccuuccagagacuucgugcugguugaaucugcacauuauuucugcucuuuuuuuuguauggggcaaacuuauuuucguauagcucuaaauuguaaagauacacagaguauacugagaaaacuuuguggcaaagacaaagaagugcccccuaaauguaacagauguugccaaguucucgugaaucuuuccagaaauauccuccacuggcacacauauguaucuauucuuugcaaacccaugcaggaugguauacgauugauuuuugcauugcucugcacgguacuucauagcagaaugcuagccuccaauugauguguucaaaaucucauuugauuuuaaaugcuuuguaagccaaaggguguguggcuuuaaaggguuaaacuauaaaaaauguuuauggauuuaaacgcguuuauaguuuuaaauguuuuaugaacauuuuaggcaguucucuguugaauauuuaggugauuuucaacaagaaaaauuguaaggcugggugugguagcccaugccuuuaauucuaguacuuuggaggaucuuugugaauucaaggucagccuuguguacuuaaugaguucuaggaucuauguagagaguaucuugucucaaaacaaaaagaaaaaaauuguaagauuuaggcaguucucagucagaaaaacuguuaguggaucugaagcgaacauucagggccuuugugcaugcuagaccagcucuucagcucugagcuaggacccaccaaaagaauauugaccccaggcguugggggaaaucuuucucuuucguggggauaaaguguaacuuggcaagccuuccugaggaagucaucaaagaaauaauguuuaaaaaggucaguaauacugaaggcgcuugugcauuuuaugcacaaaaucaaaauacucuccaguuacaagccuugauaauggagcaauccagacuuagagcaagaugcugcacuagcuccaggggacaaggcuugcaacccuucagugaguaaauucaguuucaagaaaggaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaagaaaagaaagacaaccaaacaagaaaaacccaagacacuaaaacagucuguuucuguguuauuugcuaaaaaaauugaaguaauuguuuuuuuuucuaaaugacuuacuuguauguguauguaugugugccugagugcauauauguuuaccacauggaugcagagccuccgggagcuagacuuggauccucugcaagaguagacaucucucagcaccaugcaccucuacaccucuaaaaacacugggucucauuuuguagucuagcccagcuuggaacucacuaaaccacaccagccuuaaacuugagauccugcuguuucagccuccucagugcagggguuacaggcaucagcuagcuaccagguaaagucgccgcgcucagauuacuuuuauuucuuauuuugugugagguaguaauggaggcagggagguauaaggaaggcucugcgcuuagcaaaaggcagcuuggucccuucauuuacaacuuuuuucccaucacucguuguuuuauuguuauuugcuuuuugagacagggucuuacuauguauauguagcaggcugaucugggacucuggguagacaaggguggccuugaacucacagagaucuacuaccuugaacucacagagagagacagggauauuuaacucuuaccaugacuguaugcgcaaaucagaggacagcccuuggaaacuaguucacuucuucauguuaguuuucagaauugcacgaaggucaucaggccuggcuguaggcucucuuagcagcugagccacccggauguucuccguuucauugcccagugcuguccuguugcauggcugaguccugaucuccuuagcaguaguaaguugggauuugggaauauguuagguucuauggcaaauggcugcagaagcaacggugcguggagucuucguacuucuucauacaugugugacucuguaagugaauuuuagaagugaaaauguugggccagcauuacacaguggacuuuuggacuugugugcauauugccacugugcacauucauucaugugcaggccuuugcagggacaggcuuucaucuccuuuggaugcguagcuuguugccaugugugauaacuccauauucucacaucucgcucgggugcuuucacugucagcuuuccuaucuuugaggugccagucauuucuacgucaucuuuacuaacacuuguuccugagcaggaagacuuuuguaguaagacaugguuuggaaauauuaaggcaugcugucuauuuugccugcucuuccccuaaggcuuuccuaaaacuuacuguguagcuuugaauggcuaagcccuuugcuuccaccugagugcugcgguuaugaacacgaaucauugugccuggugucaugugaugcuggggacuaaaccaagcuuugcaugcaucccaggcaagcccuaguccccacacucuuuuaccccaaagacccuuuuuuaaaaaaauauuuuucaacaggauuucucuguguagcccuggguauccuggaacuagaccaggcuggccuccagcucacagagaugcgucugucucugccuccugagugcugggauuaaaggcuugugccaccaacaaacacccaacaacccuugauuuguuugguuuuuguuuguuugcuuuuuguuuuuuguuuguguuuuuguuuuuugagauaggguuucucuguguagcccuggcuguccuggaacucagaaauccgcccgggauuaaaggcgugcaccaccacagccuggcaacccuugauauuuuuauagcagccuguuaaaaauguaaaugaauuucugccaacaccagggucuuuugacugugcgcugcuugcucauuguagauguuugcgugaucacucuuguucuugacuaacuaugacuagccucauuucugugggguuuacuccuaucagaagcagaccuacucaauagggguagaauucccaccccaauccacucagcgugcuuuguuguuacuguuuuuguuuuguuuuaaaauugaacuguauuucugauguaccaugaaaaccaaaucuaaagacggugaacugugcaccaaaugcccugagauacuaaaaaugccagaggaagcuucaauuaguuaaggaaccagggagaaaagaggucuugaguuuuuaguguguugaaaacuguaagacucggaauugggggaaaucagugagaaaaaucaaaggacaaaggaauuuuaucuuucuaugaaccucuuuggugccagaguuccaaagcuuuuuucaauuaucaaauaauuaaaauagagccuuccuuaaaugagcaugcaaagguuccuuauuuuguuuucuuggguuuuuuuuuuuuuuuuuuuuuuuggucuuuucuuuucucugcuucgauucucuucucuucuugucuucucuucucucucucucucucucucucucucucucucucucucucucucucucucucuuucuuucuuucuuucuuucuuucuuucuuuccgagacaggguuucucuguguagcccuggcuguccuggaacucacucuguagaccaggcuggccucgaagucauaaauccgccugccucugccucccaagugcugagauuaaaggcaugugccaccaccgccuggcuggcuaacugaggacauuuuuaagcaauugaacacagcuacaaaucugaucaucucauaguugauacagaacguugauuuauuucacuguuuuaucuuuuaaguuucuaauuauugaagaaaaauaguaaauaguuacuauuggcugacuaaagacuuuguuuuuauuuuauuuaugcuuguuuuuagaggcagagucuuuacucauguaggucaguauaucuugaaauugauagguagccacguaugacuuugaacuugugauccucaugccuucaccuccguagugcugugauuacaggccugguuuacacagugcuggggauuaagccaagagccuuccacuaggcaagggcuuuacugacagagcuacauccgaagccccuguuuuaaguuucuuuauucucccuccuuuuaaguuuccuaggaucugccaugguuuaguguauaucauaauaacuuacaggauaaucucuaguuggggucaugcuagucauuuccaagcacugggugucuuaugggcagcacaggcuccucagacaaaugagagcaaccaaagcagcacuccccucuccccucuccccucucccuuuaggaucuuuaaaauucacagcagaugccauuggcuagggacguuuauucauuaauucaagaaguguuuauugaaugcuuacuauguaaaauucuuuuguguauucauuguuugcccugugggaguguauuuuucuggauagaagaggaaauacugugugacacagaacacagaggacaaaguaaauccauuuccauugcucuuguuguagcggaggagaaucuccucgacguguccguuugucuuugcaccugcaaugugccugugcacucuuaccuuugcugcauccugaacccgucuugauuucucugcuuccuagcucuaaugcaucuucuagcucuggcaguuccaccgcacauaggcaaagaaguuaagccucaaaugcuauuucuuuuauggcuuuauaguggcaaauaggugaggagggaguggugcaggaccagcccuaaagucagggaaucaccagccagcggucaucggcuauguucuguguuuauaaaugauauuggagagagcucagccaaaaccacacugagaauucuuaggauguagguagacggcauggugcaugcugauaacaguucuggaaaaauucugauugugaguuuuaggaaaggugcuuugugggugugcaauuuuuaacauuuuaaauuauguuaauucucucucucucucucucucucucucucucucucucucucucucucucucucuguguguguguguguguguguuuguuuguuuguuugggaguggguggauguauggcagucagaggacaacuugcaggaacuauuuuuucccuuccacugugugaguccuaggguuugaauucaggcgguuaggcuugggcagcaagcaccuuuacugaucuacccaucuucccagccauguguguguuuuaaauaauuucaagugauuaucuaaagauaauaugacccuucacuuucccaagaggaugccaucaaaugcuggagauuagagauuugggcaaauggauggucucuguuuaauaaagcugugacugcccaacuuuuccuuuuuccaacagauacaacugcuucauaguuguauaaaaauuacucggcacgcuggacauuugccagcucaucccuugccacuuaggcaagcaggcaugugaugacggucucuuggugaacaguaccugcaaaucgaauuuagaacugagaaacuagugaauuuggacaaauacacaacacaaauacaguaugcaggucguccuccaugcgugcuguuucccaaauugaccacuagcacgggcccaacuuucggacacgucauuuauucaauaaugcccauugaauacuauccucaggugcuagaaauaaagacccgguaccaggacaucucuguucuccuguauuuguuuuuguguugagaaaacagaacuuggaaggugagggugagagacaggggauggcaaucgagugcugugcuugaaaucugcggggcagguuuugaagagcgaggucucaggccaagcuuuugggaggcugaaggacucaggaggaaccuuacuuggucucugccagucacuuggacugauuguucacaaccuucuggagccccgauucuccagugugucaaagaugaaauaaagggacaugcauggccuggucuucaaaugccuggauugaggcuccaggguuacccagguaacaauggugggguggcaccgggugacagcagugagguggaggucauucugcucgaaggcuccucccagcugagaggcgcacaguccccucuccgugaaucagcacugaggcagugagugcaguugagcugacagcucucagcugcuacacugcuggcacacgaugcaucagagucagcgaugaggccagccuucagagacaccgaguguccuuuaaagacuucaaagagcaccaguacaccaaagcuccaauuucacaucugagcuguuauccuggagugcuuauagguuguuaguuuacucgugucucaaugccgaggcuucacuugggagccacagaggugaagugggggccuuacaacgacagacauggacaacagaggcccuuccauuacuucauccguagcagagacauguuaugugcaagggucaaagcuggaaauagauuuuuuaaaauuauuaugaacuagacuuuucccuuuacauuuaucugugugugaaugcacaugcccuggguaugugugagccuguucucuccuacgugggagacucuaguauaccaguucugagguuuaacugcuuagccaucuucccagccccacauuaaugucuuuauuuuuauauuuauucguuugagguaggauauuccuauguagcccugauuggccuggagcuuaucacuaaguggaccaggcuguuuucagcagacacacagaauuccacuugccucugccucccaagugcuggaauuaaagauguacuuaguugcuauaauuuccaaucccgauaaacccauauaaaaacacacacacaauccaauuauaaauauaaacuauaugcuuagauugggcagaucuagacacuauacucacuuauuccccagcuauaagacccuuugcuacuuacuguuucuccuggccaugugguucagguccauggaggcuuccuccucuucugucuucucuccuccucucuugccucuucucucuucuucugcccccacucucaagccuccugagaggaagguucacaugagaucaacugaguauucgaaggacugcucuucugggggaaccccucuugaggaagcagaauuaacaucagaauacaaacaacagcaggacaacccacaaccggucuuuuauuauuuuggcuaagauuuaaaaauuaauguuuggggaaguucacuuccguaaacaguauuuuaccauagcuacagaauauuuuugccuaagucaguccucuaagaugcuuuguuggauuuuuuuuuggggggggggagcaaagaacuggacauacuguuuaugugaacaucucaaagccguuugucaccuggaaggcaccuuuaccaguugcauaagcaggaucagaaggugaagaaacuguacuagacauagagaauuggagucuguagaagccaaccagucuucuaacauggcuucuuuuaaucucauguuuaaagcuuccaaacuuggucauuuagcuucugguugguguuuuguuuguuuguuuuggguuuuauuuuguuuuguuuuguuuuugagacaagguuuuucuguguagucccggcuguccuagaacucacucuguagaccagacacuggccucaaacuuagagauauaccugccucugccuuccaagugcugggauuaaaggcgugcgccaccacugccuggcuguuuguuuuuaaauuaguuuuuuuguuugguuuguuuuaaauuacuuuuuaugugcaugaguguuuugccugcaugugugucuggugccugcugaggccagaaguaggugucagauccccuggaccacgaguuacagaauguuguggggugcugggaauggaacccaaguccucuaccagugcacuaagugcucucaagcccccauggugucuauugguauuuguuuguuuuuaggugaccuggcuucaauauuaugcagagauuauuguagaaaaacgcuuccaaaaacagaguugauuauaaaaacaaggcaggagagauggcuuagcaguuaagacuauauacuguccuuauauuuucuaucuaaaauuuauuuauuuauuuauuuauuauaugugagugcacuguagcugucuucagacacaccagaagagggcgucagaucucauuauggaugguugugagccaccuuguaguugcuaggauuugaacucaggaccuucagaagagcagucagugcucucaacugcuggcugagccaucuuuccauccccagcuuucagcuucuuauaacuucagcucuaggugaauucagugcccucuuggcuucguuuagaaccuguacacauuugauaugcacacauagacacacaauuaaaaaguagaaauaaaucuuaaaagcugguuuuaaccuucccaaaguagaauauauauauucuaaagauuuuaaacuuacauuuauuuaguguguauguuugugugugagaaagaaagagagacucugugugugucugugugaacaagcauagaugcuggcgaauugguuuucuuauuucacaaugugugucccagcuaucgaacucaguuuuuugggcuugguggcaaguuucuacaaguuaugccaucuugcuggcccuuaaagucaaggcucuugacgugugauacguacaacucauuugggcccuguuuuguagagguuuuaugccccgcccccuuuuaaagcaacuuuucaugaauauugcuccaucaaagguagucagguccuugacuccuuuaugguucuuucugauacuuguaaauaguaaaaucuaaucugugaguugugagucucgguugugucuauuucugcuuguccuugguuugguuugaggugacagcagcucugacuauagaucaccuucuucacaacugaagcugaaacugcccuuccugugaaaagaggaguugaucucuguauaugcguaauaccaaaugugauuuccggguauuuuuuuguuaugaauguuaaaugaugaaugcuuuugguaguaccaaauuugucuuuuaaaauugaaguaccuuuuaaaauggugcuuucugaaauaauauuuacaauuaacugauguaagaguuauucuuuuugguuuguuuguuuugagagagggucuuuaaaauaauaguuucuuucuguuugggcauuucugugccuaccuggcagguuuauguaauuuuuuaauucugugaagcacaagggaaauuucaugaaaugcuaguuucaauugggucucugggaagggcuuuuauguucuguuuuggauucagacaggaaaucaagcugugugcuagggaugggacccaggagggccucuuguaugauugucaagcucucucgcaaaacuacagucuuagucacuuuuuuuuuuaaguauucuaauuuauuuugauuuucaaguuaaauaagggaaccaguggucccaaccauauaacauguuucaauaauuauucucucucucucucucucuguguguauguuuugccuguauggaagugcacucuauguauucgauaaccugagaaaggccaucagauccucucaguggaguuacagaugguugugagccaccacgugggugcugggaauggaucgugggucucggcgagggcagcagaugaucuugggcacugagccccugcucuaggacuguccaguucuuccuaguucucaacaucaguuauacgccagaggagcaggucccuuagagggugcauuguucaccagucagaagauuuagucccucugucuggaaagcagaggaaagcugugcuggaauuaauucuagaccagcaucacacaugacuccaugacuucccagguaguucauuuuuaucccauuaaaauucuguuggcagccugcuuuucacaaaagcaaaacaucuuguuccugaugucacuggaauuuguuguuccuucagguucucauuugaaagugaaauuacucucagcucugcugugcaguuuacgacauugaucucuuuauacccaauccauaacgcuuuagcaucguuuacgaauuucgaauucugcaaagcucucuauuuuaggaccaucucugcugaaucauucucugaguuuugcucuucuguaugaauuauucuauggaauuaauuaaaguaucuauucaguaaggaauuaucacacaauugcuaugagcaagaaauuguaccaagaauuuauuccugagggagggggcagaggacuggaagauuuauaauauugugucccuaucucuaaacagggagaacaguagauuuuuagucaucucagagaagacagcuaacaaggacuuaaccauguggcuguucucuuuaaacuaucaguuugagauaguuuuauguuugaagugucacuugacaguuccugcaugauuucaguuacuuuccccaguaaguugucggaaaggauccauuuuaaugguguaucuuugugugucuaucugugugauguuuuauguuuguuuuguuuuguuuuguuuuuuaauucuaugcuuuaccuuuguucuguuuggacacaaacuagagucaucuggaaauagggaaucuuaauugaggaaugucuuuuaucagauuggccugugggcaugacugugggacuucugggauguagaaguagauguagauguagauguagauguagauguagauguagaaguuucccuuaucacagaacauggagcagaaaauuagucauccuagggaagacagguaacagggacucaacugaguggcuucagaucccaccgccagguuccugcuugaguucccuuggugauagacuaucaccuggaaauguaagaugaaauaagccccccucuaccccaaguugcuugugguagaagccacugaauauuuaguugcuaaauauuucaguagcuacauuaggugugugagcugaacugaaaagcacacuaacuuucacauucuuuuagggugcugagggagaaaugcuuugacaaggaugucugauguaauugaaaauuauguucuuaacucuaugaaagauguucucaaacugcauuuggaauuaauuguugaaauaauaaguagcuuguuggaagugccucacacaugagacugaaacauccuaacgugcguuucuuccccuuuugguauugaaauaucagcaaagcuuaguuuaugaagguaauguguucuuguuuuaaaucauugacuccgaaagggccuaaagcacaaauucagucaagacacauuuggauacauuuucaaguugcauccuugccuuggcugcagggagaacugcaacagggaucucaggaagggagcugggaaagguguggcugguguauguagccuuugcugccugcaaagggaggacacuuagcaguggaugccuugggaugaugggauaccuaaaguuugaacugagauuuuuagaguuuccuuccuuuccuuccucccuuccuuucuuccuuccuuauuaaaaaguguuuuuuuuuuuuuuuuugaguccaggucucacucauuauguguuccuggcuggcuuggaaccugcuuuguagaugaggcuagucacagaucugccugccucuuauuccuaaaugcugggauuaaagguguuugccaccacacccaguuacauuacuuuuauuuaguuugagcaccugcacacaugccagggacaguuauauccugcccugagggucuugggggaucaaacucaggcugucagccuuggcagcagaauacggacuuuucuuauuuucucuguagagcaggaacugacuuuauuuguuuauuugagcacuucauuuaauuuuugaggcagguuucaaguggccaggcuagcuacgauuuuacuagauagauagucacggguguucuugaacuucugauccuucugccucuagcuggugcugggauuucagauguaucuccccaggcauuuuuccuuaauuaaaacauuuucauaguuuccaaaaugaagauguccagggguugcaggcauguuuauuaauuuccuuuuuuuuuuuuucuuuuuuuggauuuccaagacaggguuucucuguauagcccuggcuguccuggaacucacuuuguagaccaggcuggccucgaacucagaaauccaccugccucugccucccgagugcugggauuaaaggccuggcucuuaaaacuuuuuaauugaagcuuuaagaacuccuacuuagcaugauauacgagggcccaagcccuugagcagaaaugacuggaagaugcuauaucaccaauggggugcugcccaccccauugugagugaacuuacgaauauggcaaccuggaacacauaagcacagccugccagcagcugaaauagguuggagaauguccuuuccaggugccucaaguuggccaaaucucucucucucuuuuuuuuuuuuuuuuuuuuuuugguuuuucgagacaggguuucucuguauagcccuggcuguccuggaacuuacguuguagaccaggcuggccucgaacucagagauccgccugccucugccuccgaagugcugggauuaaaggcgugcaccaccacgcccgcccggcuggccaaaucucuuucaggcaccucagcuaguuucuucugccagaccgcuuaucugguuucagucuuagcagcuuuguaugagaaucuuugcagcuuggcuucauuuugucugagagggacucuucagccuuucuuuauucuugaaaagaggggccuagugaauaugaucaguuucagggacuuccuagguuauuuguuuguuguuaucauuguuuugagacaaaguuucucuggaacuagcucuauauagacaagucuggcuuugaauucagagaucugccugccucugcuuucagacugcugguauuaacggcaagaugcgaccuuuuaccuuccuguuuuuaaaagcuucccugcaggaccugauuuuucaguaugggaggaaacuguuacacaacagugcauucaggggaaggagggaaaaggggaaaaaaaaaaaaaccaaucugcagauucuagucaucuggggcugaagaaucagcugucauuaacaagaaaccagagccucugaagugaaacauuuggcuuuuggaacaaucaaugcuggugagccaggcugaagaaucagcugugauuaaugaaagcaucaggucugaggcucaugaagucuucugcgaggugaggugcguaaagagucaaggucaagaccuguaggcaauaaggacuuguguggcuuuaggguucuauuggcgguugugugaggagcauccagaaggccgacgggcagacagauccugacuguggugaauguguuaagacuggaagaaucaaagcauugccaaggugcaaugccaggaauggaucuccauggagacucagcggauucagagucaaguuccauuuccaggaacucauuguucucaacuaaauggagcgugucugagggucugaagccaacucuaagucuguuuucuaacaagcuagguaacaacuguuaggaauucuugagacuacuguaagauugacaccgcccccuccccuguccccacccccauguuuaaccacucaggacuuugaugggcugugugcgauagccuuguaugaagucauuuagcuagcaaggagggaagucauggguuacaggaugugauuacccaaagucuucaaccaguaccuuuugguugcagucucuuacugaccaaagccuugcacuguauaccuuguuucuucagaauucuucuuuugguuuuucgagacaggguuucucuguguagcccuggcuguccuggaacucacucuguagaccaggcuggccuugaacucagaaaucugccugccucugccucccaagugcugggauuaaaggugugcaccaccacugcccagcuuacucuuuuuuagcacagggaaaagaaacuuguuaccacucacccugucagauguguaauugaacaaagcugaaucuuucuucugggacccagaguuagagaucguuccuuuccuuagccuacugaauauugguuggcaacauuggaauuuaguggacuaauuaguuccucucaucuuacccagcccuuuaagcccguuccucaacuaaggguguaguuacuauucuggguucuuaacaaacugugugucagcguucuggucacacuugaugguacugccuugagaaccauugaaaaagauaaaaucaucccuagucauuuagaaauauuugccuuuuucagggacaaguuugggagcaacaguggggacaaagguggcaaguuacggagccucaacaacuugguaucugaacaaagagggccguggagagcucagugguagagcacuugcuuagcaugcacaaggcucuagguucaauucccaguaccauauacauaaaauuuucauguuuacucuuaaaaauuaauuacacuuauuuguuguuggucucuguauuauggcauaccauaaaccccgaggccugauauuauuugaugucacucggacauugcuggguaucacaacucaggugucgagguguuucagaugggcuacccccauauugucauaacaacuugagaaauauauagagaacguuuguuugcuugagacaggguuucuuuguguagcccaggcugaccuggaacucugaucuaccugccucugccucccaagugcugggauuaaaggcgugcgccaacacugcccacaccaagagcuuuuugcccuccaaaaaaaaaaaaaagaaaaaaaaaucaaagcaugcacagcuuguccugagagaccuuggcuucccacuucccguggagcugaugccaggccugugcagcacagagagcauagaggcuguggcacggagcuaaaugacacuacagggaaaucagauguaauuaagugaccuguaaguaaagguguggaugccuggcagagcaguguggcuuggccaucuagauugaugaauacagggcuauuggugggcaccccaccugcucccuucuguuuucacucugcugggcagcauuccucaagaugcagagcuucgggggaaagcucacuuuuauggauuucguugcuccuaacccaccuuguccucuuaaacaaauaaaaucuugcacaccaucucauccaaaaucugcaguuugguguggaauucaguucccugagcuacuuaauuacuucccaccaggcauucacagaagucaugcugagaugcaauaaugagaaaugagcugagggcagucgcagccaguaaugcuugcccagcacgcacaaagccuugcauucuauccuuagcccugucaaggugaugcaugccuuuacucagugcugggaagguagagacuggaacagagaggcuuuuccucaguccuagaugugucugcacaugccccaccccugagucaguucuaagucguagacugguucuguggggucagagcuuggaauuacccagaugccacagccaaaugacauugucucccuugaugcucucugcugucacuuuauuuguuagguucagggucugaggcagcccagagaaaucagccuuggccaccuguuccuaguaggccagucaaaugaggcauaguaaaagcauacaugaauuuauuuaauguggccacuuugagaagaggaaugaauaaagagauccagugcccaucccaaguucuaggguucugauggggaauuuagguuuaaauaggcgucggagcuugccauagcugugcacaccuuuaguuccagcaccugggagacagaagcagguggaucuaugugaguuccaggccagucuggucuauguaucaacuucuacuaagucagccagggcuacauaguaagacaagguaucuaacuaggcaagacuggcugagguauggcccuacccaucauuggcuaggcuccagaguuucccaacaggcaguuugguuaucagaagguugcuccuggcuguuaccagacuuccguguuucccuuuuucucaacuuggaauuucugaggaaaucccaaucucuuggaguauauagucugauggccaaagggaggggcacaaggucucuagacuauuuccauuccugccaagauugugacacucccuguggugagguggggaugacugcuggacgccgagagucuagugcuuagguaagauggacccuguuagcguuuccuuuuguucugcuuagcuugccuuuccuucaggucauuuaaccggugacggaugagugccuggugugugucuggcccccaucgguucacgugucaggaugcuuggcucauagggaguugcauuauuaggagguguggccuuguugaaggaagugggucacuguaggggagggcuuugaggucucauauauaagcucaagcuauguccacgcccaguguggaaucagagucuccuccuggcugccugaaaauuaguuuacuucugcugcuuuuggaucaagguguagaacuugcuccuccagcaccgugucugccagcacacggccaugcuuccugccaugcuugguagugguggacugaaccucugaaacuaaggcagccccaauuaaaugguuuucuuguguuuuuguuucguuuuauuuuauuuuaugaguugccuuguucauggugucucuucacagcaauggaaauccuaagacauagaguaugucuaagucuaagaggcuuagugcugggaagucgagacugaggccacucaggcauccacaguggagggaagccuaucuccuaguauuugcuuugcugaccagggaggcugugggucucacuucucagcaguuauguuagaacugagagaccgauugccuauaagccugcugccaugccugagagcugccagaguaagcacaggcacccucuccgcagagggccgugcuagaccguuucagaaguggagcucugaggagcaaagcuaguauagauggagccaugugguaugucaucagcagagccacucugucuccuuauucuuaaucuacuuuaccuuuuaaauaguaaauagauacauaaauaaaugugguuagcaugucaggaaggaacagauaguccuccuaagaaaacauaauuuagaagcagucggcauguaguaugagccaguccuggcuaagucccucccuacccaccacugcccagagaacaauuggcuucuguacucuuuccuuugugagaccucagcaccgcaguuccuacuuuuuaaauuuuacuacuacuacuacuauuauuuuuuugagcaguuuugacugaaaauagguaaaaauauuauuuuuguuacuuuauuuugagacaggucucuauuuuguagcucuggcuguccuggaaccagaauggccucaaacucaagagagauccacccgccucugccucccaagugcugggauuaaggguauacaccacuaccacaucuggcagauaaaaaugcuauuuaaauucccauguuuucuggugaaucuuuguuaucagggucucuguagcccaggcuagcuuuggacuucagcugaggauaacccuaaccuucugaucauccuaccgcugcuguccacagugcugggauugcagguuuauaucccacaccaguguuaggcaguucuggggagccagccagucucugaauuccugcgucccaagcucauuauuaucuucuucuuccucuucuuccuccuccuccuccuucuucuuccuuaucuucuuuuuuucuucuucuuugagacgggguuucucuguguagcccuggcuguccuggaacucacucuguagaccaggcuggucucagacucagaaaucugccugccucugccucccaaguacuaggauuaaaggcgugugccaccaugccaggcguggaguugguuuugauaucugcugggcccaagcucauuuucuuuucuaauuuuagguugcgauauaauuauuuaugaucuuaagguaauuauauuaagauuaccauucauuguguuucaaguccaaagaagucaagauucuuuuauuuuuuucaauuuaauuuuuaaguucauguguguguguguuuggcauucccauauucauguggguauccuuggaggccaggaaaggacauuagauccccuggaccugggauuacaaguggucaugucccaccugaggugggugcugggaacaaacucaguuccucugcaagagcaguacagcucuuaacugccgcacucacugucucuccagcacccgagaugcuuucuucagcuaccuauucagcucuggcuccuugaaguuauaaaguacagcuuacauacaaucaaauguuuaguuagaguuuaucaaguguaugaaccacugcucugaaccuucuuuccgugggguuucuugucucauacccacuccaugaacaagucaauuugugucugggccaguuuugccugcacuugaacuuuuguguacacaauccugaagugugagcuucucugcuugaggucaaagaugcagguguuggucugagcaucaugcacuugcucucuuugguuggcguuucacuggggagucugcucauugacugauggucucuaguuguuacugguuguuucuagguguugucuauaacaaagcugcugugcauauaugugcaccaguccuuuuguagacacuuuucuuggguauauggagaggucaaagggaaaguuaacuuggaagaaauugccaaccauuuuuauugggguuuuguguauuucugugccugcaggugggugaagaggccagggucaauguugggugucuucuugauucacgggcaguuuccaccccccccccccacuagcauaugggguucuaauguauggaggcuucuuuucuguguuuugugucucccuuuuuguuaggaguaggaaggggugagguuagguucgagaguguuuuaguuugccucucuguugcuaugauaacaccacgacuaaaagaaacuuggggagcaaaggguuuauuucacuuacaggucacaucuaggacgaccuagggcaagagcugaaauaggaacugaaacggggguggggggguggggaacgggacucagacuugcuucauggaggggcuugcccagcuaaccuuuuuauacagauaagggauggcacuacucacagugggcugacucuuccacauucauuagcaauuuuuuuuuuuuuuuuuuuugguuuuucgagacaagguuucucuguauagcccuggcuguccuggagcucacucuguagaccaggcuggccucgaacucagaaauccgccugccucugccuccccagugcugggacuaaaggcgugcgccaccacgcccggcuuucauuagcaauuuuuaaaaaaugucucaaauaucacaggccagucugauugggacaguucuucaguugagguuucucugcccaagugacacagaaaggcacagaauugaacuguccuucuggcaaaagggacuugggaggacugaaguaaaacuaagccaguccaggaaaaacaaaggauguucuuuuaaggucuucuaagguuugccuguguguguguguggugugugugugugugugugugugugugugugugugugugugugcugugcccugaggaguaagugaauccaaggucaguugccauuaucaaguuaaguuaagaaacacuguguucuuugcaauuuaggguagggcagguguuuggaaagucccaaggacacuguuggauaaggaaggggcuucuuaaaauuccacagaauaaugagccucauuaguguaugacuuauaggacauggccauagucagucagcuuuaggucugcauguguucuuucccugccugcaguuuuucuuugaggccuuuauuacuuaaagucuuguuugcaggagggucaggcuuccacuuugccacuuuucuguguuaguggaccguuaauauuauuuuaugguucuuaggaguauaggcauaugcucauggcucuauuucuuucccaacaagcagacguagucuuucuaaucuuagccauucuagcagacggaccgugcugcuuccccgugauugaaucugcauuacucugacuuugcauacuucuuuuucaugaacuacaggccauuuauuuucuuuuguuaacuaucuucaagucuuuuguuccaguuuccauuuuaaaaaaauauaauguauuaaucuaugugcgccacagaagaaaaacacaacaguacuaccguaguaguguuuuuuaaaucacucugaauuuuucuaaaggaaaauuaucagaauggacuagaauugugacuuguccaaauuguuguuuugagagacuuuaaacauaggagauaaaguauaauuaagaccuugcuucugauaaagaaaggcucagcuuucuagucugugggugcaaacucauauagagcuggugacugaauguggggguuggcuaauaguaaaacguuucuaaaacgugcagcgagugaauauuguagucuuugcuuguguugcugccuguguagcuagcuucauugcacccuuugguucugaacuugcagugggacagaauugacaguuuuugaaaucuccugaaacuuaugccguuauuuauguaaaauagcauguguucuuagcaccaaugacuguaaaaucaaaaugacuccgaagaaaucuuucagaugcuuuguguccuguaauaucagauuauuugcccccaaauccuuuuuuguuuguuugaagacaggguuucucuguguuaagcccugacuauucuggaacucucuuugcagacccggguuuaaaggugugcaccaguaucacccucgccaacaguuuauucacgugaauguaaagaagcacacccaaaaaucugugggcaaagugguuuccuguaagaaaguuuaagagggucugaagugaaguucuuucaaaauguuccuuuaggcaagucuuuauuuugaaaugagguaaauauugacauccaucuuucccccccucugaaguuauuacuuaaauagaaaaauaagacucuguucaaguuucuggcuuauaacuguagaugagcauccaucugccuaaagugcccuguaugucucuucugugacuucucccugggucagcucugacaguugugccugauggccacgugacaugccugcgguaaaaucugaccacacccuccugcccuacuauucuguccgacugagucaguguccucagacucgaggauccaccagacucugccuccccagugccaggaaugaaggcaugcgucaucacugcuagauuuuuauugcugugccaugaccaaaagcaacuuggagaaaaagguuuauuuuagcuuaaaacuuacaggucaaagucuuaucacugagggaagccagggcaggaaccuggaggcaggaacugaagcagagaccgugaaggagcucugcuuaccggcugcugcucaugucugucugugugucugucuguguugguaauggagccccaggccuuuacugaagggcagcagcacugggcuauacuuuugccgaauacuaaggucuuguuuguuucugagacaaggucuuguguauccccaacuggccugaccucaaaguuuauguggcugaguauguccuugaacuccuguuccuccugaucccacuucuuaagugcugagauugcagguguaggacaccaugcucaguuuucuauggugcugggcacaaacucaggcuuuuugcacaggcaaacagcaucucacuaagcugcaucugcagcugacacuaggauaugaacuggacuuuuucacauagccagaaugcaugugagacguguuggauagcugcagugaagcuucagggccccuuguuuaaaagauaaaagauaggggaagucaauguuuuuucucucagucaguggucauaaacuucagaagucacacaacagggcugaaggaggggacaguaagagguagcugacuagagguagcaacuggcuagagagacauuguccauugagagugaguggcugaucuuuggccuugggucuguauggggagaucuuaguggaagagcugcugcugcauauacuauacugaacaggggagcucagcacacacaggcugacagggaaagaaagcuuccuuucuacccagaggaauauguuuucccgugguaaacuaauuccaagauguucuuaguaaguccaagucugucuggguauagaucccuggcagagcucucacuugacagugcuugcaacuguugguugcaaguuaacugguuuaguucucaggccugaagaaaccagaaauuugcaaaacccaggacuuuuuguuguugcuagagacagaaucuagaugaguacucuguacacccccaagccccaaagacucgggcguggugguacaugccuuuaauuccagcacuugggaggcagaggcaggcggauuuuugaguucaaggccagccuggucuacaaagugaguuccaggacaaccagagcuaugcagagaaacccugucucgaaaaaaaaaaaaaaaaaaaaagguugugugaaucuguguguguuguggggucagaggaugacucaggaauucauuccguccuuccacaguguggaucccaggaauugaacucaaguuguuaggcuuaauagcaaaugccuuaagccauugagacauccugcuacccugcuucuuuuaguuuguaaaaaagguuuguuuuuaaauccugaggcuagguguagaggcacaccuuuaaucccaacacucauggaggcaaagccaggcugaucuguguuaaaggcuagccugaccuaccuguuaaguuccaggacagccagggggauauagagagacacugucucaaaaaaaaaaaaaaaaaaaaaaaaaaacaaagcaaaaaauaaccaaaacaaaguaagcaagcaaacaaaagucaaaaucgugcaauuuccaaagauuagagagugcacaccuuucaguguguggagagggcccucuucaggcagccucaugaagugcuucacaucucaauaugaauuuagcuuugaauaaacauuacccugcaagcuuaguuuucaaaaucuugcccuuuugaauagauaauauguaaccaaaaguucaaaagcuauaaaaaggcauaaaucuuucuuacucuccuuuguuucaugcugggucaucugcucuaaaaaaugcuaaaacugcuuaacaauuuucugacuuaggugucaguaguugcaggcacacagguuuuaaggcacacauggaaggcauccucacggguaggggugcuugcaagacggccugaugacuuuagguuggucacuggaacucacaagguggcaggagaugaaaggaccucaaagagugguccucugacugccacacacacauaauaaugaaaagaaaaaaaaaaaccucaaacuuuaaaauggcauuucuguaauuuuuguaauaauauaauugaaacuggguuugcuuggugaauuuagaauauucuugacuugcuuauuguuuauuacugugaaaacuaaggaauguaucgccagggcggugguggcgcacgccuuuaaucccagcacuugggaggcagaggcaggcggauuucugagugugaggccaaacucaggucuacagagugaguucuaggacagccagagcuacagguacaaguauagaaagaauccgugccccauacugacugcuguggggugugugugugugacagagagagagagagagagagagagagagagagagagagagagagagagagagagagagagagagagagagagguaggucaugaucucagucugauacaucugagauucuagaauaagguuaagaaauaugcaggucuuuggggaucacaaauaaugugucauuuuuaggagaacuugcccuuuucauuuucuuucaagggacuuucauuggcgacuuuucacuucucagcacuuuucuguagaaaguuugggaaaacuuggggagguaauaaagaucuacagacucagcaccauaugacacccaacaaaaguggggucaacuccaucccauccuguguguuaacuuguucccuugagauuaagaacauagacugaaaacugugaaugguugcuaggaagcacaucaacuguuuugcuuuuagaccauccccauaccuuuaacauagcaaaugaccggaguauuacauuuauuuuaauuaaaaauuugugcgcccuacccccacuguguggggaggucagaggauaacuuuguagagugguuucugggcauuaaacucugguccucaggcuuacaacauugaagggcaaguacuuuuaccugaugaguuuucuuuaggggagacugaccuugaacucuugaucuuccuuccucuuucugccuccacguacuggauuauauucauguccaacuccagcagagucacuuggcaguuuccgaacucuggugcaagagcccaggugcaggccugucugaucugagcugugacucuccguugcuugggucggggagugcccccugguggcaggcagcgguggugggcgggagaccgaguuuguggggaagguugcgccggccuggccucuaaauccuuuaucacgcgugccugggucguaccggccagccgguuuugagcuggcccaguguacccaaagcuagcuuagucgcucccuuuucaagacaucuggucucuggccgcgcgugccugugugucugcuuucuuccuuugcaggacacuuggaccuaguugcgugugcucgugggccaggucucuuuccuucucucuuucucccucugcagggcggcugaccucuggucgcgccugcccgugggccuggccccuuuugcaggagacuggccccuggcugccccagggacguccuagaguuuggacuuccgggguuggcucccagucugcugcuugucacccgccagggcguuuccgugcccaugcaugggcgcggcccuuuaaacuucacuguuuuuuagacuuuggggguguggucacacuuucuuuuuuuuucuucccguccguccgucgcggucaucccagacucgcggguccuucucuugcccugcuuuccagaugcuuuggagucaugagacgggagggcgcagggaccccucugauggccgaggugauccgaggugagugcacggggcaggacuuaggauggcuggaggagcgacuugcugcccuaggagcccaacuggccuccuuucuggguccacugacuuuggggguaaaccuuaaugugccuuaaugugcuugugaccccuauguccuacagccucuccacccacccugugugggagcuggugaaauucccaguccagccaaagaucaaaggucauuugugauuagaaaggacaaagcccugucacccauuugaaugcggcugcaagaaguuuguugcauuuacuaggagauauuugcagcuguucugagagaggagauacagauuggaaaguuuaaaguaccauuugagaaaaggacgucucggcucuuguuucuuaccacuuugauuuuugccauguuuuggguguagguaucugagugcuguuaagauguugccuuuuucuggggguuggugggaauaaagauggauggagccuuugaacaucacuucccuucuugcugaacuccacagcaucugacucaugcaacacagauucuaccccagucuggccuccccucacauucaccuugauuuuaaacagcaauuuauaagaaacccaaagcagugauuccaauuuaaaaaauacguaucuaugagauuaauuguauaaacauaccaccuuguguucuauaguuguaaacagcaacauguauuuucauguauugcuacauguauuuucagugugucaucguaaacuuaaugcaugguuauaggcuagcuaucagagguaugcugaauuuccugaaauuucuuagucuaguugcugcagaaacugaaacaguaccacuacaugaaauaaucaccuaccaccaugguccuuacuaagauuaagacaauuucuucuuuaaagcuuugcuuauuuauuaauauucaccaaagagacuuuuugaaguuacacauugucaccucugccaucugaaacaugggguggggugggggggacacaacaaaaucaaacaagccaucuuugaauucaucagaaaggaguugggucuuggcuggggacaccuguuuaagaacuugaagaaaagaacacugcuguuuuccauugcagaucgccuuuguuuugccauucucuacagcagaccaaagagugcaacaaacgaacauuauuucagcauagauaacgagcuagaguaugagaaguaaguauugccucuuggaagacucaaacuuuugaaauuuccucugaggaaucucuagguaugugugcagaugacauaggcuuggaaaaauuguauaucugaaaaacacuugcagcugggugcuguuucagauucuugguuaaaaaaaaaaagaucuuugaggauacaaagaaccucuauuuaaacccugauuaguuauucuuauaguuuauacuauagagcuguguaaaauaagaauguguaaaauacugguuuugcuaguggauaauaugucaagaacaauuuuuuuuuuuaaauugagguuaguuauucuacgauugguguguguguguguguguguguguguguguguguguagggcuauguuagggggagguaacaagaucuggugcaaguagcugagcucucugcuaaugaggugcauaacucuagcucacuuguugaauaauuauguagguauuguuuaccagaauaauuccuucuguuaguauuaguagggcaggaccuuagaauuguauggccaguguuaauuuggguugguggaugcccucuugccguaauuuuaggagcguuuacauucagagcagcuaaaacauguauacuuguuucuauuuauuuuuuuuaaagcuucuaugcggauuuuggaccacucaaucuggccaugguuuacagauauuguugcaagauaaauaagaagcucaagguaaaucuuuuaacucaagguuugacugaagugaucagauucaaaacgggaaagagugcuucuuccucuuacaaaacaaaaccguuugagaccaggugugcugagcacucaggcgagagaucccaaguucaagacaagccugugcuacacagcaagaucuuaucuuuagaaaacagaaaaaguuuaccaagacaccaguugccuacugaguuauguuuuaggaugcuuugaaaacguagcgaacguuuagaagguguggcggagcgcccccgguagucucaguacuuggaagaaauagccgugagaucacuuggugcacagcggcuguuuaagacuguacagccugaccgacauugugagauuuucuaagugguguuucucauugugggaguauuuauuuagauuguguacuuuuauuuuucugagucugcaaaaaauggcucuguaaucaagagugcuggauacucuuucagagacccacacuguacaucaugacuaucugucacuagaguucuagaggacaugacacuaccuucuggccugugugccucugcaagcacauaguacauucauacgugcaugcaagcagaaacacauguuaaaaauauucuuuuuccuaaacuuauacugccaucuauuuguuuccuagaguuuuuucugggcuuugagacacacuuauaugcaaccccggcuggccuagaagugucugcauccccucauggauacaccaacacaugucacuuguguuuucuaauuuuaauggaauggguuauauuuggguucuuugguuccgguuuggguugaagaagcucaaacaaaacaguaacucacagcgaaaggcagcuacuuaacuaagucccuugucugaccucaugggaacugaagcagacaagggaaacgcuucccugcuuuggccagaguuucuccugccucccuuucaaagagagugcuggugaaugguuggggaaaacauugcccucucugagcuggaaucucacucuucaaccaugucucagauuuuuacaaaguaccuagucauuguaaacuguucagcagaaaauacuaaguuuguuagcaggaauuacaaauaaauaaaaacuucggauggauuuccuaccagagaacuaugugaaacaaguagcauuuauuuuugcuuaacacuauuacagauuuauggguaagggagauagucuuuuuuucccgagcaucagcugcauucacuauacauuuagacacaaguguagacuucuuccuaggccuucuuagcaaaguaaacauccauggccuucugucuuugagucccccuccccuuuccccuucuucagugacagucuuguucccacagggccaaaaggcuaaauauaauucccucuccucccaucuauuguuccugugcuuuaguuuugaaagggugagucuaugcaugugugcaccugugcacacaccuucaugccuaaccugucggagucuuuuauucuucagaauaaaugaguguguuccuuucuagugacuugcuggaggcacugacaagguguugagcaacaagccuaagaucucacuguccgcugagcuagugagauugacagugccccggucgaagagggugcccauggcuggcuggguuuuguuuuuguuuuuaauugauuuaggucccuuaguccauauaaaccacuaugggaaaauacacucacauugauugaugauggagacacuagaacauucaaacaagcaugggccagugagauaagcagugcauucaaacaugcugaacauacucuguugcagcauacugauacauuucacauuagugaaccacuggggaccugcugggugauggugucuuccuuuucuuuuaacuucuuguugaaguauaacauacuuaaagaaacauucacagaucccaaguauauacuuaauuuucauaaauuaagaagaggccuuucaguugcugucucacggacugucuuuaacuaguagcuuuaggacuagagauauuuuguuguuguuuuuguuuuuguuuuuuugagacaggguuucucuguauagcccuggacuagagauuuuuuuuuccaaaaagauuguuuuuauguguguaaguguucuucaugcauguauguucaugcauguaugucuuugcaccaugugugugcagugcccucagaugucagaguacauggaaucccuggaauaggagucagagacugauguggcaggugggcuucugggauuucaaggccagcuugguguaccuaaugaguucagcauagccagggcuaauaaugagaccuugucucaaaaaaauagggcuucuucaggugacuuucccagcuuguuacaucuccuguuauaggaagcccugcauuguugguuucucauauuggcacaucuauccaguuucuuuugucacuagcuguggauacuucugugaccuuauaucuccucagaaaaauauggcacuguugagggacaguggccuccaacaagaacuuuaguccccacaggcucuggacuuaucagucuuccuucucucuuggcucuauccagagcuuucugaacugauccgaagguugccugucuuuaggccuguaucuguucacauuucccugccucccuuuuauuuuaaauaauucuaguaucacagaauggcuccugggauuucagggcuucaggguuguuguucucagaguuuuaauaucgagguugcuuaugcaugugagguguagaauuugucacaaagcaaaauuuuaggaaacuugaaguggucaagaaaauacuaacaacaguuuguuuugaugcaguccauuacaaugcugaggaagaaaauuauccauuuuacuggcacugaucagagaaagcaagcgaaugccgccuuccuugucggguguuauaugguaaguguccugcucugaaggucagugagcgcagccgucccgcuguacaggcaggccugggguuucgaagcuacucuuuccuaagaugcuguuucuagaggcugugcgcuuguuugcuuugaaaaucauucacuccaggaagacuugcacccgugcuguggggagcaugugcgagucucugugugcucagugauucgcuuuguuuuguaauuaaaguuuuuugacugauuacaacggagaaaguugauaaucuguuaagccuuuaaggugaguggauaugccuuccaaagcugcugcuuuuauuaauucauaauuuguuuagagaguuguaaagucauuuuacuggggucaggcccccucucucucucucucucucucucucucucucucucucuguguguguguguguguguguguguguguguguguguguguguguguguguaugauagaagauggcuuucaggguuuucagauuaucaagcuuggugacaagcagccauacaugcugagccaucucuccagauaacucuguucuccuuaaagauguauuuauuuguggaaaguauuucuuugugaguguauaagcaugcauguguagcugugugcacauguugaguguuaaaccuggaauuaaaggucuccccucucccucucugcuguuuuguuauguuaguaccagaaucugaacuccaguucucaugauuguguaacaaggcagcaagagcucaaacucaccccugcuuugauacauuuguuugcuuacacuugugaccuugacccuaagcuuaugguaucucuacacugggcuuugcccccagcaccuuauaccuccucauacucuaggaccugcaugauagaaggaaagaacugacuccacuaagaugucuucugaccuccacacaugugccaugcuggccaugcaugugcacucuccccuucccuucccucuccucccucauccaugugaauuaccuuauaccaccucauacuccuauaaucuucuguuaccuaguuugguaaucuguaguuuacaaaaauuggguuaguagaguuaguugaaauugcaccucagaauuagauucuuuuagguauguagggugucucauuaccagcugccuaggccuuuuggauuauucuuuccugguuaugcuuaaaaaaguagcagagagaaaaguuucagagaaaacuugacauuuuuaguacuucauccuugaaggucugagauacaggaagugaauugugucgguugaaaucugaauucuucagcugaguuguuucugucucuugguguuucuuacacuggcagcaaguccuuaaaaaaagaaaaaagaaagaauggagaacuuguugcucuugcaggggaccugaguuugaguuccaaaacccaugaugacuacccauaacuaacugccuauaacuccaguuuaagggaaccaaucuccucuuuuggcuucuagggacaccugcaugcaaauguacauaugcauaauuaaaaauaaaauaaaccccacagugucucauuguauagcccugucuggccuguaauucacauggaugagggaggagaaggaagggaaggggagagugcacaugcauggccagcauggcacauguguggaggucagaagacaucuuaguggagucaguuuuuuccuucuaucaugcagguccuggagaucaggcucagguccuagggcuugguggcaaguagcuuuaucucugacccaucucacuggcugggcagguggaucccuuaacuaugacauugguuccauuauuugcccaacucaacuggggaggagagccucgacuaaaugacaccuuaaagagaaagugaaauuaggauuaucaggguucacaaaacauuaauggcaaccuggagaaucaguccucagugugacagaaaaacuucuaagguguuuguggggucuccccacauucuguccaagagaaagucugcaguggccccgacaguuccaccucagggacagggcccauauccaugaauucuuaaccaggcuucccuucucuuuccacugucaaguaaagcucuacuggccacauugugugaagccaguggcugcaacuccaggguggagaacucagaaaauggucaagaggaaugguggaaucacaggguuaaaaccagaaagaaaguacuggauaauuuuauaaauaggaaguugcucuugcuguggugguuuuuuguuuuguuuguuuuuccaaggcagaguuucucugugcaauaauuguggcugucccggagcucccuuuguagaccaggcugaucuugaacucacagaucugccugccucugcuuccugaguucuagcauuaaaggcugcauugcuagugcccugcucauucuucuguuuuaauuuguuguuucugaggauuaaacucagggccuccagcauccaaucagguguucugccaucaacugguacaccuagcccauggcugguguuuuuucaacagugaaugagaaagauaacuucuuguauuuguggacaauaucuuguuguauuugguccauuuugaugcaccuuuaacuuugcuaaugguuauaucugggcacacagaacuuuaguuucguuucuguguuuucaugguuaauauauggguuuaaaauuccucugagggguuuagccuugcacaucaaugcugguuccgugguuaagaauuugccagauguacuggcugguuuuguguaucauuuugacacaaguuagcaucaucaaagaagaaggagcgccucagcugaggacgugagcuccaugagacccugcuguaaggcauucucucaauuagucagcggggagggcccagcccaucaugggcggugccaucccugggcuggugguucugaguccuauaaugaagcagacugaggaagccagggguagcaagcagcaccccuccguggccucucugcaucagcucuugccucagguucuugcucugcuugaacagugccgagaaaguguaagccaaauaaaccccuuucuccccagccuggucuuagucacagggguuucaucgcggcaguagagacccugacuaaggaaacuggauagauuuggaaagucaucaaguuuauuacucuccucauauggaagccaguuugugagaagaccagaguuuguggugugacaggcgucuuucgagccacgaugggugggcuaaugggggagcuuggaguaguuauaaugcuuuguggggaagcaggagaaagacuuccaauaaaagaaaguuauuaauaguaggaaagaguguugacaugugauaaagacacuucgaaagauaaaacaccuaagugagcaaggcuucuuuuguuugagccaauuuaguucucugguuaaagucuuguggagaugaacgcuaauuccuaggaacugaagucuuaauaacuuuuccuggagcuguugaaguuuagagguaguauaaagcuugagcaguaauguugaaacaaaccaaagaccuggaaagacuuuuagcucagcggcagccuagcuagcccuaacacuugccuagcaugauagggaccccaaguuuacauuccuggcacugcaggggaaaacaacaacaacagaaaggaacagaaggacuggagagacaaagcaguggguaagagugcuuacugugcacaugugagugcuuacugugcgugugugagaaucugcauuuuuuuaaaagauuuuauuuauuuuauauauaugaugaguacaucguagcuaucuucagacacaccagaagagggcaucggaucccauuacagaugguuguaaacuaccaugugguuguugggaauugaacucagggccucuggaagaacaaucuguguucuuaaccgcugagccaucucuccagccccgaggaucugcauucuuauuucaguacucaucugugacuuggagacuuauuuuuggccuguucccaguagcucauuucuauauuaucccauuuauaguguucuaugccuaccacauggcuggucgccucuucucaguuucaugugugggacuucuuccgacguccaggcggugaaucucucucaccugccuauuucccagaguuguucuuucucucugccagaugucccaccuucuaauccugccucaguuuauuggccaucagaauuuucuuggugaugcuuuuacacauuguacaagagauuaucccuacagucauguaaaaaauugagcauggcuacacauuagcccucgcauugagcagucaagagaaaugagccuccaguucagugacagacuugguuucaaggguuucaaguuagaaauacaggaaaacaacugaugucuuccuuuggccucugcauauauguggauagguaugugcccacacaaacauguggauguaacacacacauacauacacguuuauacacauauacacauauccauacauagguacauauaauuugcauacauuucacaaacacugaauuaauaugcacgcauaugugaaaaaauaauaugcacagcaauacuuccuuuuuuuauuagguauuuuccucguuuacauuuccagggcuaucccaaaagccccccauaccccccccuuuuuuuuuuaaucuuuuuaaaaaccuuuaucaauacaagacucuuugguccucuggaaaccagauuuccuaaggaaaauguaaagugaguagcauuugcuauuugugcaaauaaaaacauuaggccaggcagugguggugugcaccuuuaaugccaacagcaguugggagguagaggcaggcagaguucaagaccagucuaguuuacagagugaguccugggacagccagggcuaaaaagggaaacccugaguaaacaaaacaaaacaacccccccccaaaaaaaguauuuuuuaguagcuacaaaacaauuuuauuauugguuuuaaagguuuuaaacaagggucaguggguuuuggacauacuuguucaacauuuuacaaaaugccaaucaacuucccuuuaaaaaaagauuuaugaauauggaugcuuaccuucugacaugugugugcuucauguguaugccugguaccagauccccuaaaacuguugaguucugguugugagcugccuaauguggcugcugggaccugaacuuggguucccuggaaaagcaacaagugcucauaaccacugagccauuuuuccaggucuggugcuuuuguuuuguuuuguuuuguuaucccuuuaccuaggacuuaaugcaugcugguuaggugcucuaccauugagcuacauuuauguguauauguguauuaguguuauuuguguauuuaugugcuugugcaaaccauuugggggcucagaagacaacuuuaagaugauguucaccacuugggacccagggaucaaacugagacugucagccuuggggggcagguuccuguauccacugagcuaucuugcugucuugggaucugcuuuuuaaauugaaagcaguuaccauucugucuuuuauacuguuaucaucugugguuacauccuccuguuaagcuuuucuucaggcugccucagcucucccuuagguuacuuguauacagggcaaaacuuguaacauuuuuaucuguuaaaaaaacaaaacaaaacaaagccuccaaguguauacuuaaugacacagcagaguacuuaccuguagcuugcaaauuugcucucuuccaugguuaauaaauuacucuggaagaguugauugugguaacuuguaaguccccugguaaauauuuaucauuguaguuuucuaagcaguucuuaacaguccuuagaauggcuugccuuuuaagcauucauauggaaaauuaugguccuaauuaauuccugagacuauacuugcuuagcagucuaugaguagacucccacagucugaaaaguggaaagacuuuaugucuuuaauggugaacuuuuggcccucugguccacuuuuaagggauucuguugauuuggacucugagcagucagcuaagguagcuucagggcaaaggaacuggauguaaagugggacugagaccggugucuggaagcugagggccagauugcauucagccaccagugcagauggugcaguggagaccauaagggagagccagguggauggacacaggcucuguaaacacucuccuguguaaaccuccuccucguguguuauaagagguagagagaacaacaaggcaacuguagacacagcagccaggccccagacagaagccacagauacagcaccucagcugcucaugaggcuuacaucucuauccacuccaguaagcaccccagacacuguggccccugggauguuggccgagcugccuuaacuuugacucuuugaccaugugugauucuuguuugcaaaucuguugcucuuaucuuuauuucaguccuggcuuuaggcaggaugguuucuugucuauaaauaagggcugagcagcggccuccuaucaguaacaagcagggugaucccagaugagcagcuaaugccuccuuuggagaagaucagccugcaaggguuauguaacucaugggguauuuuuaaaugguugugucccuccacccccaccccauguuuaaaaauugagaucacagugcuagggauauaguuugagaguacuugccuagcaugcagcaagccuuggguuugaucucugauacugaauaaaccugaugugauguacuuauaguccuuaagucuugagaguuagagacaggaguaucaagaguucagccuaggcuacaugagacucuguucuuuaaaaaacaaacaaacaaacaaaaaaaaaucuuucuuuuuuaaaaaaaugaaaauguucugagcauggugguauauguuugccuuuaugaauuccagcccuggaaaggcagaagcaggugggucuuuuuaaauucgaggcuggcccuggccugcauagcaaguuacaggcaagccaagguaacauagugagauccugccucuaaagacagcaucaaaaccaaaaugacuaaacauuuuuagagacacgugugaagccaucagaaaaaagucagagaaggaaucaagaguuuauuuuuuguuuuuuggguuuuuuuguuuuuguuuuuguuuuguuuuuuuuuauauacuguagcagcguucagggcuuacccccaaguccagcucacucauuuuuacuaacugguuucuguagagaggaauauuuauuuauccauuuguuugcuuguuuauuuggggggugguuggaggcaguguuucucuggcuaauagccccuagcugucuuaggcuggccucaaacucacaaagaucugccuacuucugucucuugaaugcuaggauuaaagacaugugauguuauaccuggcugguaacaaggcauucgauauucuagacuucaaguuccuguaccuaaaguaaggacaacuauaauauucaguaaaaguaauuaacaaagcuaaggcuguugaaguguaaggccaucugguguuuuuauuuuuuuguuucccuuggaagcagggcagagcuuuguggcucaaguugauuucugagucucaguucucuugccucagcuucucugguacugagauaacaggcccaugccaccauaccuggcaaucugauuaguuuggggaaaaaaaugaguuaggggcugggcucaguugcuaaagugguugaggaucugaguuugauucccagagccccugaacagaagcuggguguggugguaggcaagaaaccacagugcuggggguuggagacaggauuucugaucaccacgguagccucacugagcuucaggacagugagaggcuggucucaaaggaggaggacaccggcgauuuucuuccagcuuccacacauguguacaacauacacacacacacacacaaaaucaaaccacacgugcauacaacauacacacacaucagaagaaaaaccaacugugauuuuuuuguuguuguuguucguaguuuuguagcucuguguuguguauauucugcuucugccuaccuuuuagcagcugaauaugaacuuguauugauuuuaugcacaugcugugguaauuuggagagaguuuuguuuuguuuuuguuuuaaacucagucaaauucuuggcacaggaaggacugugucaucuggcugacaugugaaaauaguuacaggagcuuuuaaaggcugcaaacauugugacauuuucugcauaaagaguauuugcaaauagcuuauugguuucuccuguggcuguguugguuguugggacccaaaugccuuuuguuguucuuaagucuggcucaguaacugguguucuguuuggucuggacacauuaucagagccucucuuaaguguguagaugaagcuucaaaguguguauaagaacagaaaugagaaacacauguuuaguugggcuuugcugcuggaggccaggcuugucaggauuaaaaccaugcacggugggguagggaugcuuuucuggguuacgaguccuucugucugucacucaggugcaccuucgaguauucaggggucacaggcccucacaaggcccagaaccuguuaucacagaccuaaaacaaaacaaaaacaaaacagugagguuugucuagaagggacccucauguuuugguuuucuuccuguaccagagaguugaguacucaagguggcuuugugcuccuggccuuaugcuuucugccucaguucccaaguagccuggaccacagucucucugucuguuuaucugucugucucucucccccucccccccagacuugcgcucauauucucucucucucucucucucucucucucucucucucucucucucccucccuuacccauacaccaccauucuuggcuguuguuucauugauuuaaaaaggaucuugaaaaacccuaccaucuuuucccuacgauauuuuuauguguauuuauuucacauguauacauggaagccaggcaaccacuuuugagauuuaguucucuccaccuugugaacaccagagaucaaaggcaggcuuuguagcaagcgcuuucaccugcaagaccaucuugcuacagguacuuaguuuuuccuuugugacuucuguuucugcacagacaugacuggccgcaucacaucucugcaauggccauguaauuuuucaguuguuuaguuugucugguuuuauaaacugaguuguuuccuuacugcugggugugcugcuacaugaccuacugaugccuaagucaccucuagaguuagugacuuaacacaguaaauaaccagguuuuuucaauguuuauuuauucacuuuauaucccaauaucugccucccccaacccuguuuauuuuguagcccuugccauguuuuauguggugcuggagacagaagccaggacuuugugcaugcugggugauaacucuuucagcugaauuacauucccagcaacuccuuagguuaggaguugcaguugcuucucuuuagugggucagguucucagccuccugguguuuagucaucuggacgauugucuucagagguggcucacacacaucccugagaagccacuguugaacuuuagcagagacacuccucccuguguggucugcuuaggauugcccccaccaugacaguuuacauuacccaggaagagcaaggcggagacaccuucucuaugaucucaucccaaaagccccacucugucaggucguuucccccuccuuuuauaauuaauuaauuaauuaauuaaugugcauggaaguuuugucugcauguaugccugugcaccacauguguucaaugcccuuggaggccaaaagauggugucucauccccuggaauuggaguuacagaccauugugugguaucauguguauguugggaggaaaaaccucugagagugugcuugagaucuggcucagauguuuaagagcacugggcaaucuuuuagaggugcugaguucaauucccagcaaccacaugguggcucaaaaccaacuauauuggaaugugaugcccucuucugggaugcaggcggaagacuguguacauaauaaauaaauugacaaauaaaucaguaaaucuugaggaggaggggaaaaucuggaaguaaaaaggguucucuagaacagcagcuccuaaccacugagccagcuuuucagcccuacacuccuucauuucugacgcugugagaagguagguuaaagguggaaauacaaggagcucauugaggcugucuuggaaucuggcugucauaguagccagucuuugucuggguaaucaucuguuucuuagcuucagaauagcaccaugacauucgagugggcauucuguauacauagcugcugauauaaauauccugaaagaauuugccgaggcauuucuugugucuaaauaagcagcagugcuauauuauaaaauuguguugauuuagaguuugcuaaacugaacacuuguuuuaggauagaaaucacuuaauacgauuccuccuaagagccacauagagaagagcuucaugugggaaagucuucucaucagaaaaaugaguugcuuugaaagcaaaagcugcagauauuuuuuaaaaagauuuauuuccaaaguugagcaugucuuuaauucuagcucuugugaggcagaagcaugcagaucucugagacugagaccagucguauacagagcgagcuccagggcuuccaggauuacacagaaacccugucuugaaaaacaaacagaaaaguauaaggguuugccuguauguaauuaugugcaccacacuacaugcacacugcauacaguguuugugcguggaguguauagagggugugagauccccuguguuuacagucguacauaguugugagcuaccaacugggaacugaacccaguccucuucaaguucagcagcugcucuuaaccacugaaccaucucuccaaccugcugacaaauacuuaauaguuauguucagagguuuagacuaaaucucucaguuucuuucaggguuaggauuaagucuuauuuuuuuguauagucauuccccaaacagauuuaaaacauuuuuuaaaaauucaucauugggaaucuggaguguucucucaccacccauugugggggaaaaugcuguauuacucuagucuuugaauugaacuuguguucuaagacuagcccacaguuauuaaugaauuaaaugcuacuuuguuuugaaguuuagaaggaaauaagggcuuuacccuuuugguauuuaaagaaaccaagaagcuacggucuuguggaguaaaaauugccuuaaauugcuguuuaaggaaaaacggguguauuuguauaaaggagaugaugaucuuggaaagcuagagaaauucugaauuauagguucucuggauuucauuugaauuauauacacacguucauggacacacacacagcaaauccagcucuuucgucuuauugacuuacagguacuuugguuuuacauuuuguuuuggugauucauuaagaaauauacugucuuagaggguuuuuuuuuuccuucuugacgguucuguuuaauauuuuuuuguaaccuucaggagaucucuugucugaaguguugcacacauucaggaguuuuauacuaugaugucuguuuugaucacuauaaugaaaguugcagugagugcucuauauagaguuccaggcuagccacacggccccauggugaacucugaucagucagccagucagucagucauucagucauaguacuacagguguacccuuaucaaucaaucagucaauuaaucaggccagcuagaagauacuuggugaacucuuauccaucagucagucagucagucagucaggcuagccacaaggcuacauggugaaccuuuaccaaaaaaggaaggaaggaaaauaagcaguuucgaugaaauagugggucugaucaucauccucuuguuaccugaacaggugauaacuguccauuugaaagcaagauguugccuuuuccuaggcucaccaacauguuugugagucucugguaugaccccauggguggcaucauugguuuucuauugcuuugggcucuuuacauauauccaccaaggcuuuuuaccccaaagacauugcaaaaggacccagaugaccgugaacuaaaccucucuaaauugaaccaaaauaaaccuugcccccccccauguaaaauuauuauccuaggcauuaugucacagagauggaaaucgaacuaacacaguugcaaauuggggcaaaaccuaggaauuguaauuuuucagccauaauucuguggccuuccacacauagccaaaacuauauaucuuaaagaaggcuaccaggaaguuuauggguuggagagacuccaggaaugcagugacaugaacauaaaugcugaaguucucagaucuuuuuuaguuuuucgagacaggguuucucuguguagcccuggcuguccuggaacucacucuguagaccaagcuggccucgaacucagaaauucgcccgccucugccucccaagcguugggauuaaaggccaacacugccucaggucucaucuuguccuuuacuguuguagccaauagggcugguauuggaaaaagugauaaggccugguucucacacaaccaaaaccugauuuugauuaaaaaaaaaauuuuuuuuuuuuuguuaagacaucaagcauauggggcacucccaggcuuuauuuuguuuuggaaauaaguagguagagaauuucaugguguucacuugcguguucaaccuccacaaugcugcuucacaggaaauaugauucaaagucacuuuucucuucuugaguugcuacuugcuguuuugucuguaccagcuagcaggugauccacaggaagaaguggcauuguggcaggauuuuuaaauuuaguuuuggguuuugguuucagcaguccuuuuuuuuuuuguuuuuuguuuuuguuuuuuuuuaauagaguggagaaaaaaaaccaagauuuuauuagaguuauuggguuuuagucaauuuucuagcaccgaaacauaccugagaucauaccuugugcuaaggggagcuucaugaugggcugugcuuuuguguuuaugccugugcucaguuugugcuggggcuuuuggggccugugacgaggggacagugcauuagggcaaggaucaugugguggagccaccugcuuacuucauguauauucagaaugguugaaagaagaaacugcaaaaucccaaagccuccuucaaggacacccccagugaccuaaacccuuugauuuccccccccccuucuccauggcaacaagcugaagaccagacuuuaauacccaggaugguggaggccaugccagguccacauuagagcaaggggcaggagacaccuggagguuauaaggguauucuaguuucauggccuaguuucugugguugugauaaaagaucucaacaagcaagagaagaaacaagcaaagagagaaaggggcuuacuugacuuacaguugcaaguuacaauccauuauugagguaggaacuuauaucacauuuacaaucaagagcaaaaagaaacaaauacauguauucuugcuugucugcuugcuuucagcuagcuuccuccucucuuuucacuguuuagaagcccugccuagggaaugggugucuuccauaaugaauugagucuuccuauaaauuaacaacuaggguaauccccauaggcaugccucucagcaagaaucucuuccuaggugauucuaggucuugucaagcuaauagcaucaaccagcauagcaggaaugaaguaaaauauaaaagaaaauauuuuuaaaccgguuggauuuuuaaaauuuacacuuguuuuuuaaagauuuauuuauuuauaugaguacacuguaggugucuucagacacaccagaagaggcaucaguucccauuacagauaguugugagccaccauguaguugcugggaccuuuggaagagcagucagugcuauuaaccucuaagccaucucuccaacccaauuuauaguuuuguuuuguuuuguuuuguuuuuuaaagauguaucaguuuauuuuauauauauauauaccagugcucaggcuucacccauaccaggagagucagaucucauuauagacagcugugagccaccauguguucgccagucuguaguccuaaauuauaguuuauaugaagcaguggcaucuuuuuuuuuccccuaaauaaauaguaauagaacuguuguuaggcucugcuuaaaagauguauguguugaaugagaguauagaugauauauguaaauucguucauuuuacuugaaaacuugauaauguaagcaauuugauaauuagguaagacuucugaguucgaggccagccuggucuacaaagugaguuccaggacagccagggcuguacagagaaacccugucucgaaaaaaauaaaaaacaaacaaacaaacaaacguuuaacaacaacaacacauuucuuagcuaggugucaguggcgagaaccuuuaaccucagcacucaggaggcagaagcagguggaucggucagccagggaacacauuucuuucuuugggggauugauugacauuuugcuggaccuuuuuccuuacugccacugaggauaaauaaauauuugagcauucuguuaauuaguguaucacuuuuuccauucugugacuaaauaccuauuaagaacaacgugauagaaggauuuauuuuggcucaugguugaagauaggugaacccgucauguaggaggauguggcuggcauucuucucagcuguuaaggaaacagggaaucuugucuugucuucacuuugcccuuuuuauuugauuuaaaaccucagcccaugggaaggcaagucauuuaucuuuagauaaaccucucuggaaaugccuucagacacucacagaagagcaucaucgagauuacuccaaugcaaucaaguugauagugaagguuaacuaucacagcuguagucuguggagagaguaaauggaauuaaauuccaguaagaaaccauucagaccuuggggaaaugguccauuuauaacuguucaaacagaaaauaaguggaauguccucucgaaauugucaaaucuuuauaauuaguucuaagaucuagcuuuauguuuaaaagguuguuuuuagguuuguuuacucugugugccugcacacacauauauguauagagaccaaaaguagacaugugugucuucucaguuauuuuccaccucucucucucucucucucucucucucucucucucucucucucucucucucucucucucucucucucucucuuuugaggcaggauuucucacugagcccagggcgccccagucuggucaggcuguucuggccacugcacuucaggcaucugccuguuuuuugugcuccagcccugggguuagacaccuguacuauuaccugaucgucuuuuacauggaaucuggggucugacuuguaguucucaugcuucuauuguaaucccuuuauccaagccccuccccuuccccggcuguggucuuuuaauccuuguuuuguugucuuauuucgagacaagguuucucuggauagcccuggcuguccuggaacuagcuccauagucuugaacucagagauccaccugucucugccuccugaguacgggcccagcagccuuuguugaggcuacaaaaacaaacauuucucaggaggcuuauaaaggaaaaacccacaaugagcccauaugcaggugcaggaagugcugcccaguggucagcucugacucaagccauuuuagacauaaaagcacauauuggccuuuaauuugauagguccuauguaaagcuuuguggagaauucuuaagauuaacaaaccucauacagaacacaccaaggguuguggucagcaugacccuguucuaugucaaguuauaucaaacauuugcauauuacugcauauugcauaaauagcuggcaggcauggaacagcuaugcuggggguguagaccucaacaauaaguacauugaguucaacguaauaggcaaaaccuuagagcccauccauuuaugcuuggaccaggaguuaagagauuggagacaaagccuucacuucagagugccuccugccaugaaaacagcuuccacauacaguauuaagcacuggagguaagaacccuguauagagguaaugguaguggcccacaccuucaguuguagcacuagaaaggcagaggcaggggcaucucugaguucaaugccagccuggucuacagaguaaguuccaggcuacacagaguaacccugucuggaaaacccaaaccaaaccaaaccaaaccaaaaaaaccacaaaacaaacaaacaaacaaaaaacaaaaaaaaaaaaauagaaguucauaauuaacuugguaacguuuucucccuuuucagccaugucuuggcuccagggaugaaacucagugccacgugcacuguagaaccugugcuucugaguuacaguuuuaaccuagacuggaauuauucuauugugaucuaaaauauauuuuccauagaucagcuuuggaauuuaauuuaguuuugaucuuuuuauguguuuaacugaaugcaugcgggucccuggcuccugcgugggagcugggaacaccugcagccaguggcagaugguagguggugaaaguagcaacagcuugauagauacaggugacugaccucucaagugaagaggccucagaacaauaaacacugaggaaaacacugcagggcacaguuggcaaagcaggggguuuggccaggugugauagggaguuccuggggcagguggaucucugcaaguucagaaccagccugguuuacauggugaguuccaggucagccaaggcuaugcacacagcucaugaaaacucugucaacaaaaagaagaaaagaaaauacguuuuugaaguauuuuaccagaggaagaccgaaacacaccacaguugugaagacagaaggagcagaugagaguaggagcagauguaguuaguccaguggcaaacguucacuguggagagagugaaucaaggccuuuguuuuggaaaagagugcaguucagugguacaccuccuccaccccuccacucccacccuguggccuuugcagaucuggguucaauucccagcacccgaauagccguucacaacugucucuaacccugauaccuccuccuguccuccucaacacugcauguacacaguacacugauauacacggaggcaaaacacucauagcauaaaaauaaauaacuuaaaaaaaauagcuugggaucagugagauugcuuagcagguaaagccacuugcugcauaggucuggggacuuaaagaguuuggcccuugggggcuggagagauggcucaguggauaggggcacugacuacucuuccagagguccugaguucaagucccagcaaccacaugguugcucacgacuuuaauggagaucugauguccucuucuugugugucugaagacaguggcaguauacucacauacauaaaauaacauacauuaaauaaauaaauaaauaaauaaauaaauucuuuuuuaaaaaagcuauauuaaaaaaaaaguuuggucuuuggaacugacaugguagaaaggagagaaccaacuucacaaaguuguccugugacuuccacaaguguccuguuggccauuucacaaguacuaaaauaauaaauucaucgacuccaaguuccacuuuaccccacuccagucagcagcuccaccuccacuuguccacuucugaggaugcucaggaaggagaauuuaaagcaugucacucuaacaucuggaucuggaaaaugugcguuuuaagacgcugcauuucugggcacaaguuguuugaaguguugguguggcagggagaaaucucugacagguugagacaagcaguuacuugugagaacauggcucugcagauuggcugcagcuugugcagaaauggcuucuuggugacagaacugugucacugagaaguaaaaaugcccuuuucuuuucuuuccaaauguagguuauauauuuggggaggacaccagaagacgcguauagaacauuaaucuucggagauacagccuauauuccuuucagguaaaugugcagguuaugugguagauguauuugaucagacucuuaccaggaaccuuaaaagaaacaaaacaaaacagaaaggugaagcccuggcaggaaggcauguuaaugauuguaacaccauagauccaagagucuuaacagugacacuguuggaauguugucacuucuggccucuguuugguagagacuggugacucugacuacacacacacacacacacacacacacacaccacacucaugcuccacuuguguuaucagaaugucaaaagucucccaguuuugccuuuuagcucuucgaaaugguagggguggagucggacuuugcugagaaccacgcugugauguagcuaggggagaauccucaugguacugugcccauugcugccccagguuccugugcaauugaucagggaguuucccuacucagcagaguuuaugggacaucaccugacaccuuuucccaagagcaccaccagaagagguggugggugcgguugaggaugucgacacaaccuguaacagccugucaaacagcucuguguggaggcgucaggccucgaugcuccaacucugugaguggauagcagccuuaccuccuagcuagugugaugaucuugaaagaauuguaaaggaaaaaaaaaauguuuuaaaagcugugugcugauuaauuugguguccuauaaaugaacucuggaaugucuuccuaacugaagacagucuccccagauaguucuguggaacccucuccauuugaaacagggcuuccauuguuggggcaauguucagauuauggugaaauggugguugaaggccaugacugagccaguguuucuucccugcugccuagcagacugucccaaguguucugcgauuugagguguguaggaagagagaaggcgcugaggugaagugagccagccacucaucuuuucaacuuguaacagcacccauuugugucuguuaggagcaauuuuugcaucugugaucccagagugagcaguaggcauauaguucugcugcuacaacacagcugugaccuuguuuggagcguucucuccaaaguguuaagcccuuguugccauucucauagcuuagaacacaaggaugcauaaugugaacaagcuuacuugcuagaacauagcacagacagccucaagcuggguuccgcuaaagccuccccagauaguccuuaauuucccuuucucauauuuuaucauuuuauuuuuuugagacaggcucuuacaggccuuguguccuggaaaacucuguguagacuaggcuguccucagacucagaucugccccacaucugccuccugaaggcuggaauuaaaagugugugccacugccaaggaccaaccucagcuuggagaggggguucugagagaugggaugucugggagcagcaaaaaugacugguccaaaucaugguccaagcugcugacgccuuuguucugcugagaugguuuuccagaccgaccucccccccacuucccauauccccccccccccccguguguguguucuuugcucuagacagcuuuuucuugcuauucuaaaagcuccuagucgagauagcuaacuuucugcucgagacaguuuucucugugagugaaaauugcaaaagcucucuggauagcucaugaauuuucuaaccaaagucagaaaaaccgcuauaaagaaaauccuuggaucaacucaaaauucuaaaaguaauucuugggcuuuccaaucaaaaucagaagucagaaaguguuuaaaagaacuguguucgcucuucaaagagccuucucuggauagcugcuagaaaacuaugaaacauucuaaaagagcugugcucauucuccauggauuuuccuauuaaaaucagaaauccuguuagaaaaaaaaaacaaaccuuuauuuauuauuauauguuaguaugcuguggcugucuucagacacaccagaagaaggcaucagaucucauuacaggugguuguaagccaccauguggcugcugggauuugaacucaggaccuucagaagagcaguuaaugcucuuaaccacugagccaucucuccaaccccagaaaaaauucuugaaggcagagaucuccagauagcucagcucuugcuagaaaaaaaaaauucuaaaaaagaacugcuuucacuuucuucuagcucaucucaugcagacccuaaaagcccacucuuauuuacauaucaauucaguuauuccagguucccuuuuaaccaucccgugaaucagcauuccaugucuuuagcuccuugacucuuagaaagagacagcaaacauaagcacagacaauaagauagcugggugagacccagcucuggaaucagcauucuaccuaagccuggaccuaaauuagcucuguccuagguuggcccugaacuugggaaucugcuggcauuuguaagcauaaacaaugacaaaacaaaaccuuuucuuuccuucuuuagcaucuaucugacaagcuggaucauagugcagcugcuucuguuccuuuagaugggugaugccccucauauaauucauauuauguccuuagauuuucgaauaguugagaaauuacauauuuugaacucguguuuuuagaguucuuuuccauugccuuaaggaccguccugaaggucccaguguuuaccauuuugcugagacaauagccacaucuuugccuaugcuguccuuauuaucauggagucaucaauauuaacagaguggacauucuucagaggaacgccaaaauacacacauuauuauacaaacaagcuuaaggccacagccgccaucgacacucauggagcccaugcuugcuggcucugucucgggggcaggacauauuauucugucccuaccaaggccaugcucgacuuggcagugacaccgugaccagccuauuucuuuuccuuccuuccuuccuuccuuccuuccuuccuuccuuccuuccuuccuuccuuccuuccuuccuuccuuccuuccuuccuuccucccuuucccuccccuccccuccccuccccuccccuccccuccccuccuucuaacuucuauuccucucucccuuuugagacggggucucucuacaacucuggcuauccuggaacuuacuauauagaucaaacucacaaagcucuaccauucucugccuugcuaaugcuggaauuaaagguguauacgaccauacucaguauccuaugauaucuuacuaaauugugucaguuaucuucuaucuuagugagggaaauagucugaaagagcacacuuguauuacuguugucuguaguaaugcucugcuucuuagauuuguuguacuuuuugugagagaguuugcauuguccccugacucucuuguuucuaccucccaaaugcuaaaguuacgggugugcaccacagugcccaucaccagguugucaaugguuuacuuugguuaucaguuagagaagugacucuuaaccuuugcuguugcuguguccuuuacagacuugagccuuacucugaagaaaaauagcaguaccugugcuauuauaauaggaguuaugugcccaaaagaaaacaagcaauaaauaaauaaauaaauuuuaaaaagccugcccucacauaguuuguacaauauccauagcccuuuuucuccuuuuuaaaaauugauaaauacaauuuguuaacagucaaacaaacaucuaauacauguguguggagugcuuagggaauagacucaggacauuauacaaaggcacacacuguaccauggggccuguaccccagcugaaaacacuaaucugacuuguacagccaggucuuacacauguguuuguguaugugacuaccacacuuugggauauagaacauggcuaucaccccaaagauucccuccugcccugugcagucaguuaucacccucccauagagacugcucuuaacacucccuuucuacugucacuuaggcuuguuugcuuuggaucuuugugugucuggaaccaucuaguaugcauuggauggcucaggggcuagagcacuuucugcacaggucgggggacuaggguuuagauucuucacagcccacauaaaugguagguggguaugacagcccaacuaucauuucugccuugguaggcaggcacagugcaucccuagagcaagcugacuagcaaggccagucauacucauacuggugggcucuggguuuguugagagauuuuugccucagugaauaagguggaggagcaauugaggaugauucccuauggcuccagugggaggacugggguguguugggggccuggaucuucaagaagcaagcuuuuauguuaggauuguguaaggcagggcuugaguaaaguaggccuugagccauuauuauucuuggaaaaaaaaaucuaugcaucaaauucuuugcaugguugaauuggugugccuuuaacuagguuaacuaaguuggagaaguguuggccauguuaagaaguuaaugcaaguaguuaacuacuuucaaaguuaugcauuacuucaguuugagaguucacucucuguugauugcugauagggccgauacaguauuugaguggaacuaucuguuuuguaguuauaagcuuggugggaugcggagugauuuuacuggaugcuauuggaauucuaacccuuaagaacaggaaaagguuacccaguuaaauuuauucaaaguucuacuauaacuaugggagcagaaugcuuguuucuguagugaacagauuaucgaagcaaguuugguuuugaauucuagucagcuuuuucuuggggugagugugguguagaacauuaacggaguaacacuuugggaauuucagagaugcugccuauggaagcugcaguuucuauauuacacuucucgacuguuuucacgcaguaaagaaggugagugucuugcagaagaugaauucuucuccacagggcuguuagaguuccuucagcuguguaagguaccgguuaacauuaaagugaucccaaaccaauaaacagcucguucuaaauuucugauuguuucuaugcuugaaugggauggaaagggcacuuacagacaggaggcaggcugggguugucauucaguugggugagcacuugcuuagcaugcgagaggccaaggguuuaauaccaacaccacaaaaacaaggcacaagagaguuaaguaauuugguuuuagcuagagacagcguuagcuuugaguguaccucauuuaaagaaaaaaaaaguugaauacuguuccccuccaaguuauuuuuauguauauacaacacaguaacugucaggugcaguggcagugucagcuuagcacaugcaacguccuaagucccuccugggcaccagcaauacaguaagugugaggcucaguuuugucucuaggugcuuuacuuugaauucaacagaauuuggacaauuaauuuguuacaaaguuuuauauaaaacuaagugugucacaguugcagucagaaaguugcaggaaugugggggguguguggcauaggggcuuagccuuugaaaauguucagcauugcauagaguacuuucuaggauacauccugguucuuaauagaaaauuggcauuuuccuuaugccuuuguucauaaacauuuucuuuuggauuuuaggcaaugcaguauggcuucuuuaauuucaacucauuuaaccuugacgaauaugaacacuaugaaguaaguucuagguuacugauuucagucucucuacucugcacuuuaccaaggugucagugaucaauauaucuguauuucaucaccguuuuguguguguguguguaugugugugagagagagagacagagacagagacacaggcauauuggugaguuuuugaggucagaagacauguuugcagagucauuuccuucucuucacuucuacauggguucuggacucaaacucacacccucagacuugcguagcgagugcuugaccugucagauaauauuuugauggauauaugcuugugaaaugacuugcagauucaaacuuguucacacaugugcuaucuagauaugcucaggacauuuaagaugcaggaacaaccugcauguaacacccagaacuuauuacuggaaguuuaggcucucaucagaauucuauuugcccauauacuuuucaaucuguuauccuaccuaaagaaauaaggagaaaaauauuaagcaauaugacaaggugcuucagagguuaauggaauuugaauaccccaagcccacaaaaauauuagguggguaugauguccugccuaucuaucagucauauuugggcucagcugaaugauccugccucaauauaggagguggaaagagaaaacaacuuauguuagccuugggcuuccacaugcuuauaccacacaugugcacccaacauacauacauacaugcauggacacacaugcacaugaagaaaaaaauaaaauaagauuguacaguaaggaauagcacaccuuuaacucuuaguuccgcauuugugauucuuagugguaguuucuaagaaugaucagguacaucuuuauaaagcuuaguuuaaguucuguuuuuaguguuggugaccuuccuauugugauguggauauagguuugaaguccacaggguggacugcuaagguauacuugguuguuauagcccaauuguacuaucuguuuaaaguaauuaaagcuaagcagaaauagccaggcaugguggcaaacaucuuuagucggagcacucagaagagauagaacucugcaaguucgaagccagccugguguacauggugaguuucaggccacucaaggcuucacggugacacccugucuuaaaacaacacacccaaauguuuuaaacaaaagagugaacauuuuguuggauucugcaaguuaaaaaucuaggagcagagcuggggaggugucuuagcagacaaauugcucucugcucaagaaagagaaccugagcugggugugguggcgaacgccuuuaaucccagcacucgggaggcagaggcaggcggauuucugaguucgaggccagccuggucuacaaagugaguuccaggacagccagggcuacacagagaacccugucuugaaaaaccaaaagauaaaaaaauaaaauaagggcuggugagauggcucaguggguaagagcacccgacugcucuuccgaagguccagaguucaaaucccagcaaccacaugguggcucacaaccauccguaagaaaaucugacucccucuucuggugugucugaagacagcuacaguguacuuacauauaauaauaaauaaaucuuuaaaaaaaauuaaaaaaaaaagaaaugucaauuuaaaaaaaaaauaaauaaauaaaauaaaauaaauaaaauaaaaaagaaagagccugaauuuagauccccccaacaccuguggaaacaggccaaggucgcaguaaacucccgucaugggaggugcagagagcaguaucccuggggcucaccggucaacuaauguaacugaaucagguucugggagaaaacuuguuucgaugaacaagguggauggccuauguauacacagcguguguucaagcacgcauacauacacgcacaugcacacacacuguguguguguguguguguguauguguguguguguguguguguuagaauguggaauguuauugauagacugaauucucugucccugccaagagcucugguccuggccugccuuaucaaaugaaacaauggagcaggagaacauguccaggcaggcaaauucauagguaucuucuauauuuuuaaacauaaauauuaagaaaaacaaaauuucuaggguuccuuccuccaaauauauggguaaggcgcuguauuaagggcccuuguagggaggaaagcguauagauucuuuguguucugcuguggcuauuuagagcgaggagaggcucuguagacagcacuccaugcguucauaucccacauccacagauaacuagcuuuggcuguuauuucuuuuuuuucuuuuuuaucuuuugguuuuuugagacaggguuucucuguauagcccuggcuauccuggaacucacucaguagaccaggcuggccuuaaacucagaaaucugccugccucuguuucccgagugcugggauuaaaggcgugcgccaccacugccuggcuuggcuguuauuucuaaagaagaccuaugauugaagucugagcuauuuucacugcaaagauaaagcacauccugggguucacuccugucagcgagcgguaucuuguaauaccacugucucuaaaguauaacuccuucagugacuguguaaccgaauuacuaagaucuuuuuuuuuuuuuuuuuuuuuuugcuugucccuaugucuuggggcuagguagagagcucagcgcuuaaaguaauugcuguacaagcaugagggccagaauuuggauuuucuagaagccacauaugccaggcagcaggcauacauggcugaggccucuaaccccagcacugaaaagaagagacagaugaucccuggggugagcuagacuagccugaguuaaagucugcaagcucuagcuucagaaauagucuguuccaaaaaaaaaaaugguguagaaaguaauugaacaucagauacacacgcacacacacaugcacacacucgcacacgcgcagaauauaaaaaaaacugaaaauggcaauuggugcaugaaguacaauguuucuauuaccucaauuguuaaagugauuuuuuucucuccuggcacugauuccgucauaguccauugguuuuuacuucuuaaaaguauguaucaugcugggcguaguuggccaugcuuguuaccccagcccuugggaggcaguggcacagagcuugguugaguccaagggagagcaucuuagcaacuuagcaucacagcaaguucagaccugccaagguuacauggagagauucugcccuagaaaagaaaaaaaggaggguggcuagcaccugaagagugacauccauggcuguauccuguccaguguguguguguguuguuguuucuucucuguggagagagugcuucucucugacacuuuuauucuccaggcuaaugacccaagcaaagaaacaguuuuaaagugauugacaccagggaagucacccguucccuggggauacucaaagcaaaauagagucucccucugucuauuaauaaacagcagacacgcuaaagacaauggcuuugaaaugaguguugacaagggagguggaaggagaugugguucaaaguuaauugugcuggucucuucuuugcagaaagcagaaaauggagauuucaacuggauaauaccagagcgauuucuugccuucugugggccccauucaagauccaggcuggaaagugguaugcaaaacucuggaauccaaguagcuuccucuuuuuccuuuugcaauagacuucugagcugggcacugcggcauuugccuguugucccacaucuuugugaguacguaaggcaggaagacacguugaguccugacuucuggugugcuguaagguucgggugucugcugggcucagccuuguucugcuugcuuccugggaaggaggccuuugagccgccugcugggggaaugaccccacccuguuuagaaagagaccaaagaauuaagcuaagcuugacucagucuucacgauuuaaccacucuugguuauuugagcacacuucugccuggauguuaacuuuuuaaacuuuuggcuuuuacaguuauaaaauugguauucagucccuaguccagacauuguuuccacccacuuuugggugggacuguuuuccauuguguucuuccuguguguuccaagcuuugugcaucucuuuauguagguuaccaccaacauucuccggagacuuauauuccauauuuuaagaaucacaauguaacuaccauuauucgucugaauaaaaggauguaugaugcuaagcgcuuuacggaugcuggauucgaucaccaugaucuuuucuuuccggauggcagcaccccugcugagucaauuguccaagaauuucuggauauuugugaaaaugucaagggugccauugcugugcauugcaaagguaaauaagcagcuagguugggcagugugcaugugagaguauauauguagauacggguuauauccuuuuauguuacauggcaagacaacuguguuuuugaaagaauaauuuaaggguuuuuugugacaucauuguggcauguguguuuuagagagagagagagagagagagaccaaccaaagacaacaugugggaaucacuucucaguucucuucuaccauguaguucccaagaauggagcacauaguaucaaauuuggcagcaacugcuuuuacuaguugauccaucuggcuucccagaaagagcgauuuuaaaauccuuaauuuguauauagaguauaguaaauuaucuucacgaguaagccuaccacagcuuuguuuugaggcaggaucucauggagcgcaugcuggccuagaacucccaacgcagcugcagacaccacacccagauccgccuuuuacagcugugugccaucauccucaguccuuaugccaugcuggggacugaacacauggaucugugcuugcuaggcaaaugcuuuacaagcuuagccacauccccagcccccagccuaccacagcuuauuacacugaaauguguauauuuauuucuucugucugucgugugcccaugagaugaguucucagguugucagcaguagaccaaagucuugcagcagcuugguguagacuaagauguguuucagcaguuauagcaguuucugaaucuaaauguuccaggaauaacuguaaugaugcacugugugaauauaguagagugucuuuaacuuuaauuuaaaaauaagguaauuaagaaaacaagggauauuaaauggcaagguuaaaaagaaaaaccaccaaauuaauuuccagcgcuaaaacuauuuuuaguuaggaauguagcuauaaucacaacauucaaauguucaguuugcaguggaagaugacaaggcauaccaaaaaguaaaauggagccaggaaaguaugaaaaacccacaaaaacuauucuugacaaggaucagauaguacauuuuccagacagaugauuuaaaacagcuaccucaacagugugcacaacgaaaagaaaaugugggaaaggaggguaaaaaauaugugagcaaaauccaagugucaauagaaaacaaaaaccaugaaguaaacccaaaaugcaauucugaaaauggauugaaaaacguacuggcaggguuccaaaggagaccugaauaggcagaaggaagaagccaagauugugaagagcagagccauuaaaaagacaccaggagaacaaggagaaaaggauugucaagaaaagaaaguagcaaaguguacaguuuggggacggagcugggcagaacccccccccaugugcacagugggagguccagcagaggagagagcagaaggaggcacauggccuggaaauauuucccacuuuugggaaaggcaugauugugaacauucucaaaacucagcaaacuccaaacagaacaaacucagaaacuaacaugaagacacuuuaugaugauacugucuaaagcuaaagacauugaaagaagagagaggaaacucagguuaccaauucugccauuagaaacuguggaggaagagcccuauaaaccuucaaaacucccucaaaauagaaguaaaaccauccucagauggucaagugcugggggaauuguuacaacuugaccuguacgauaucaguuaggacucuagacaguacucaaagccacaugaagaagcaagugucuacuguagagguugauauguacauagguuaaagucuaguaauugcuuguaaaauauugucacuguuuugauauaaauacuauaacacauaaaaacagaaaaccauuauagaaaucaacaaaauccagguguggucaguucuucacaaaguuuaacaagaauaaaaauaagcacaaaccuuuaguuuuguguuugaugauugaagauaaaagagaaaaaaggcuuaaguuauugcaugagaaguggcaguggggacaauacucgucuguagacgagguaagagaaccugaacucggauccgcauguaaaaagguagguauggcugcaugcaccccuaaccucugcaaaggggauggguagacuuacucagcuuacuggccuguccaucuggcugaauccagugagaucuagguucauugauagacccugucucgaggggaauaagguggacugguagagcuggacaucugugaauauauacacgugugaacaaccaguaagagaugacugaauagccaacagaauguuggaugauggaaaugaaauagaaaauucccaggaacaaaacaggccaauacagaaucaccaugagaugugggcagugggcacagaaucuagaacacugagaagguaacagaguuucccagcuaaggaagaggaccugaugcauggccugugacuaacaccaauucucugagauuauucaaauuugaagggaauggagaacacuguucucuaaggccaggauugcuuugcuaccaaacacaagcaaagaagccgucuuuguaaaagccacacaagguaaaagacucauauggagcugggucucgauugguagagggcuugcuuugcaaacgugaagauugcaguuugauuugcagcucuggauaacccaugguauagaucugcagucauagacacaagagggucagagauuuaagauuauccucagccacauagugaguuugaggccagcuuguaguucaggagacccuguacaguagaguacaauacaauucaccguaccaaaccauuuuccuggaacuacagaacuaaaguaacauaggaaagucauuguaagucuccacaguaacugugaagcucaaaaaacacauaaucaucucuguuaguauaggaauagcauuuggcagacuucucgccccccuuuugugauaaaaccacuaagaacaaaauggaacuggaaggaaacuacguccacacagccucucacugaaaccuuuucuuugcuugcccucaucugagguggcuuuccuaacagcuacuucagucuucucccauacaguuauagcauguuuauauagagauuuauuaaaagaaacuguagucacugagucucucaucuguacuguagcugccuaacugaggcgugaaugcagggugcaggaggaccuccuucggguggaaggcuaaucuuuuuguucuauuuagaucuuaaauggauuggaggagcacugccuacauuauggaaagugaugugcuuacuaaaauuggcacuggaugaaaugccaaucuugaccaaaauuccuuccaaguugauauaacacauuaaccaucaugggaguuaaguauaauggucuccauaagaggaaagaaauagggcuggagaugacucaucauauaaaguguuugccaggcaaaugugagacugcaguucuggucucuagaagacacagaaauacucgguggccuuguagcucaccaguaauuucagccuagaagggagagagauggggcauuuccagaccagacuggccagccaaauggccacagcuguuagguucaguucagaaacccucccuuagugaauaagguggagagcaaucaaggacgauuccuagacaucuacuuagggccuccuaaugauugugccccccaccccaccccauacacaaucaaaaauacgcacugcuggauuaucucugaugcaccagcucccaaauaaugacacugacaccuuuuauuaauuaugaaugcuuuaagccuaaguuuaggcuuguucccagcuaacucuuauaacuuaaauuaacccguuuuuacuaaccuauguucugccacguggcacacuacuucuccucagcaccaguacuugcuucuucucugcaacuggcuggcaaaucucuccaaccauuuuuuuuccaaaguuccuaucugugucggauggcccaccuguccucuccagccuagcuauuggcuguucagcucuuuauuaaaccaaucagaaggugcuuuagacaggugaggaaggacagagaaacaucuucaaacaguauccuaaaagauuaucccagcaaacaugcacacauacucacaugcacaccacauugcagagacacauacacaacagaauaaagaguuaaaaguaaaaaugagguauaguuuagguugaagugcuugucuaacauaucccaggguuggguucugucccuagcucuccuguaaagcggagugugaacugauacaaauguugaguagguaauacuguuggauaugguaacaaaugcaaagcuugggcagaaaacagcauacuuaaaaauacuuguauuugugugugagugcgcgcgcaugugcacacgcaugcacaugcaugugccugagugaauauguguaccacacuugugcgggugccuuugaggccagaggguauuugaucuccuagaaauggaauuccaagcaguuacuaucugggugcugggaauugagucugggauuuuagguccucgguaagaguaguaaguacucuuagcgcuaagccguuucuccagcucaaacuccacauuucuuagaggucccuguucagaaagugauuuucaaucuuuggcuuuacauugauguaaaauccucuggggggacuucagaagacccuggauucagucuucugcuccuaggcuguuaccacuuaaaccuugagggucaggccuggcaccuagccuuuuuuuuuuuuuuuuuuuaaacuucuucacauuuuuauucuuugugcacaaagacuagcaugaucgguuccacuuccuagucagucgaauccauucaaggucguuuaguccaacuuaaugaagccuauguccuucgcauacugccggaagcauuggaggcacauguucaccccguauuugcagaucagaucguggcgguuagagcaggcgcggcaagagcaggaacccuggccgaacuuccgugggugacuccagcagagcugcuagugacccaucuugccuucagacgcccgacaagggaaaaggggcaccuagccuuuuaaaaccucuucagauugacucagagaaccucuguagagggaggcaauacccugagaaggcuguaacuuuuuuuuucuuccuccuauucagaaauuucuggaagaugugcaaacagauuucauugaugugguuuguuuuucuagcuggccuuggucgaacaggcacucugauaggcugcuaccucaugaagcauuacaggaugacagcagcugagagcauugccuggcucagaaucuguagacccggcucaguaauugggccccagcaacaguuucuggucauguaaguguacuugaagcuugucuucuguaagaaccaguggcugugggauggggguggaggcgauguccuuacggaaagcuguauuuuugauguuguuuaaacacuguaggaaacaaucaagccucuggcuagaaggcgacuauuuccgucaaaaguuaagagggcaggagaauggcccccucagagaagccuucuccaaacaccuuucggaugcugaugaccuguccuuaaaugggcuugagaaucaagacaaucaagagccugagccgguaauggaaccaccucggucacgcuguuguaauugcuguaaaugcuuuugagauccuuguagggcauggcgaaacuguagguaaagcuuaaaauaaaguggcuuuuaggggcugauaccacacagucauguuuacauauauucauaaccuucucuagaaauguuugacugaaaagaaaguugugugcuuauagaacauuccguugacuuccuaaacacagauggcaauuaucaguggggaguaagcuccuaagacagagcugcuuacacuccaaccugagugugccaucuucaucucaacuggauuaguaguucaaauggagaacuuucaaagaaccacuguuguagcaggcaacaguacuauacuagguuaaguaguaaugaauggauauucagacuuuaacaaguucuaaaacuaaaagcccauucuauuauguaucuuuaccccuuuauagagggcuuugugacuagugucccugaaagucagcuuugauuguuuugaaauauggcugguagcuugauuuuugaaaacugccgcuuagcauucagaagaaaguguguguguguguguguguguguguguguguguguguguguguguguguguguguguaugucugaaugucuggguaaguagccacuuggcugcaauagaaccuaaguuagcucaguguuuauuuuuuuuuuguuguuuguuguuguuguuguuuuaacacauguaguauagugaugaugaugaagucaguggaaugacacaaggagacagacuucgggcccugaaaagccggagacagccgaaagccagcgcuaucccccucacgugagugccucccucccuucugaucacuugucuguuauguuuccuguauacuuuucuccauagcugcacaccauuacuuuguagugaucacuugugugguuuaaaaucuagaggugcucugcugggaagugcuaagcacguacagucugaggagaugaaugcauuuaucucuguguccuacuguaaccucuagagccaugauugguaagaaaacaauauuaaggaaguuuuguccauagacaguccagagagugacagcagaugucaagaccagguuaauagauuugucucuagguauuaaaaugguuacuuguuauuccacucccuuauacauguccgucaucagucuguacacaggaaaauugagucaguugucaugauguucugucaucucagaguaaugauaaacucauccccuaauuauguuuuuauuuauuuauuuauuuuuggucuggagaauugaaaugcagacaaagguuuaucacaagaauaaaaaguuucauaguuaguagguguuuuuaucuccauaugaacuucuuaagcacuuguauuaauuuggauccaacuacagggaacauccucgaucggcauucaaauacagggaagcaaaguaugaagcugcuguacguuucucugggcucucucccauaggugacccccccaggccauugcuccugucauuauugguguuucccuuucucugugagaaggcugauggagauaagucucuuuaccauagcucucuggcagugcaguaaauguuagggaugugguucuucagcaugccucggcguccagcacguuguguguggggggaggguuccugacacaaagggucaacauuuucaacauaaagucuuuugugaauucugauuuuaagugucuauuaagaauucuccucuuuacaaauaguaccuuuuguuuaauuuauuuuauaugaauagauaaaaauauagugaagaaauaagaaaaauauauugaagaaauaucuucaaaugccaaguuuuaaaauuauuaauguuuuuaucugaggccuuucuaguuauuuuuauucacaaaauaaucauccccaaacuaauucugugccugauagaggaagguaggucauaccccacagcagccacccacagaccuagccgagccuuggagucaugugggagcuuaccauauaaugcaucuuguaugagauucugauuuccaacaaaccuucuugcuugccccuugcugguuguggugguguuggggagacuuugacauccuuugaauugcaaauuuuacggguuacacacacuuuuuguuuuaagauuggcuguugccaaguuuacuucuuuuuuuuuuuuuuuuuuuuuuuuuuuuuuugguuuucugagacaggguuucucuguauagcccuggcuguccuggaacucacucuguagaccaggcuggccucaaacucagaaauccgccuaccucugccucccgagugcugggauuaaaggcgugcgccaccaugcccggcuaccaguuuacuucuuaguagguuguuuugcccuacauucaugagccagguuaggagugagaggggagacaaauucuuucuggucaaaaguucuuguuggggagcuggagaaaugguucagugauuaagagcauuaguuguucuuccagaggucuuaaguucaauucccagcaaccacaggguggcucacaaccaucuguaauggaaucugaugcccuacucugguguuuaugaagacaaagcacucaugaacauaaaauucauaaauuuaaaaaaaaucuaccaaacuaaaguuauuuuuuuaaaaaguucuuauuggacuggauaagaggaccggguucaauucccagcacccacauggcagcucacaacccucuguaacuccacuuccaggggaucugucaugaucacauggauuuacaugcaggcaaaacuccaauguacauaaauuaauuaaaucauuaaaaagcuuuuguuagcugcuguaaaaaugcccggcaguugaaagugcuguccauacagaggccccaaguuuggcuuccaccaccuagaucagguacaauacaaucagcuguagcuccagcuccaggaaauuucugcguucucucucucucucucucucucucucucucucucccucccucuuucucucucucucuccccuucccccucccccuccccuucccccucucccucucucucucucucucucuuucucucucacacacacacacaaaaucuuuuugcaaaaguucauauuaaauagaacuuucaggaaauuuuacucuccacucuguucagaaaaguguuuuuuggaacucaaaucauuuagugaucucuuuuguuagauaaacugagauuauggaguucauagccugaggguauauggugacagaaaagcacaagaagauuaaaauuuaaagacccccggaacuugcagguggcuucagauguccuaccauucagcagauugugcaaggcucuuuggacuagaagucugaugcucucagaaauggcugaaugagaacagcuagaugguuuggggagagcuuagugggaccugcacauauauguguguucacacaugugacgacauacagcacaagcacacacacaggaaacacgaggccaaaacuggguauguggcacagcacuuggaagguggugguaggaagaucagagguuuaagggcacuguaaacuacauagaaaggucaaggccagccugagaagugggagaccugaagacagaaggaagagaagggaaaacauaccaaacucuagugugcacuaguuacuuuuucuguugcuaugaugaaacaccauaaccagggcaacuuaauagaaggaaauguuuauuugggcuuaagguuucagggcuuuggaguccccaguacagggaagcaacaguauacgugugguaagcauggcagcuggagccggaaaugaaaacuuaaauuuugaacugcaggcaggaagcaccgagagcuaacugggaauggcaagccaccuugaaaccucaagguccacgcccaaugauaugucugccccucaccuccccacccccaaucuccccaccccauccccgucgauaccacacauccuacaccuaccccagcugucucaacuacuugaggacuaaguauuuaaaugccugaggccaugaguaccaucucagaaacauacaaggccacaguagcgaaauugauggcucuuggucaggugcacuucuguaauccacauugccaauugugccguucacuggaccucccaacugacugaggaguguucuguuuuuguucagaggcguucccuggucgcagucaccccuccccugaucauauuagacugucuguggguuguuucuguguccguuucuacuuguguucagguguaguguuuugcauaucuaaggauggccagcuggaguacugucagucaguaugaugggagauggagucuaaccauuuguuccuguguguugaaccuguuuaaacuaaagucagcguuuuugucucaacagaagcuggaccaccaccacccuuguuuccugccccuuugccaucacagucgcugcucugggccuuuuagggugucuuaaauccacagguggcucuauguauuuuauuauaugauuuauuuuggcuucccaaugugaacaucuguucuuucccuuccacccucuccagauguccccuagcugugcugaccucugcacuguguaguguugccaucugguggauugugugugacuacauucuucccacccugcuguucugucuugauggcuucagaacacaguagccaucuggacccuuugacagauaguuugcuguguaaguuuccuguuccguuucucuccuacccucccccccaccccccuguguccugugugguuccuaugguguauguguuucuccuucuggcucuccuagcuuuguuguuuugcuuguuuuccagggcucucuuuccgaaucucuucaaugaaugggaugguaccagcaggggagggccucaaggagccuucugagucaaggauguuaaaaauaacaccuaguuuugaaaaguuguacuagcuauucauaaauguggacauuggaauaguuuucucaccugucaaaaaaccagguaguugagccaaccagccugguuucguguccaccagggggcuguauucaccucucguguucaaugccuggaaugugucuucagucaagugugucucucaccauuucugcuuuuagcaaagauugggcuuuguugccuuagaggcuagugaggaugguggcccaaucucuucaggucaccugucuugagucuauagaacuguccauucuuucaucacaucuucuuuguguuaagugagaaaaggagagggguagcuggcugucucccuugcuuguguuucuauagucucuggacucuuccuucucuuccccaaaauaggcagaccaucuuuguuagauucuguacacaaguguaaucuccugacaugucauucucucaagggagacacuugucagcagaaagcagcagaaaaccucuguguguaacaucacagcccaggaacacagagggagacaugugccacaccaccaccauccucuaucuguuuucugagacccuucuucaucauuucauuccaaaaauuuacuuuucuuguaccagcuuggacuuagagauugccaaagcauucagaauucccuucuaggaucuccuccaagugaaaaucugucacagccaacccuugcccuuugagguucuguugagaguuucauguagcuaagaaagauuuaaaaaggaaucaagaguccacuaaagaaaacuugcugaauaaauacuuauuuacagugguguuuccuuguauaucuuagaugaguuuauaaucucacauuucacuuuuuuuuuuugcccccucuaucuauugaagaacaaugauaccuuuuauaguuaguucuucccaaacuauucuaaguggccaagauguucugaauggguagguggaguugcugcuaauaauauuugucuucaggcccagcuuaaauguugcuuuaaauguuacuucuacuggcgagcuccucagaguccucugcaagagcguuagauuaguccuguagcuuaugucaccacuacguuuccagaccaaaacaggguguuccguuuagccugccuacugacuugaauuaaaagcuuucugugacugagguagguaacaguguggucuucauagccacucgcucuuggugugagacucuucccaagaggcuuaauuuguggguaacaguucacugcucuguggugacuggcccugcugugagcugguaggugagcuuugccuuguagugaguuccaucagcugguggccucgagccuaagaccagaaagcauuuuauguucucuaucuacugcacacagugggggacagugcuauuagagaaugguucaggggcuuguggggcauccuacagaaagcucuguggcagugauccucuagaaagccaucuaugcauuuugaggcuuggcaggucacuccugguccguaagacuguuuuucuaacuuugcugugcaucucgucauugucagugucuaaaaucugcagcugcugcggcuuuagaaauaccacagacagggcagcagucuaugguuugggcacagggucaggaggaugaaggcaaacuugguuggggaagagagagagaaaagaaaaauguauauuuuguguauugauaggaagaaccaugugagcagggcagguggcccucucguucugucugagcagcucuggggcuuucucacuuuauuuaauggauuaaguguuugcucaggccagauaaccuaaggccuccccggugugguuaauacguacuaaauuuccuucugaguuuuaaagcuccacagaaauuaguaaccacuaauaucauuauuucacauuuguuuacaacuguuucuuagaaaaauaaaucaagcaguaguagaucuuuguuuuguguagcauuuaagcauuucaguaauuuaagagaucaggaguagguuuccugagcaggcauuagaguguguguguguguguguguguguguguguguguuuuaaaaguuaccaagcguuugcccucagauggucugagaugggggaguggugggcguuacagaagaagccacucauuuuucucccuuguaaagaagcagcagagggaaaugaaguacacacacugccagaagccuggagaaaucagcagguggauuugguugccuuaaagcaacauucuagauucauguccuuaugagauaaauauuuccccugugauuguauuaacagaaauuguaacaguuggauaagagaaguagcauuaauacucuguauagcccaguacaggguaacccugaucaacaacuaacagaauuuuuuaaggagagggucuuggagguucccaacaugagguaugauguauaaggcuauggcugagccagccaguccucuuauuguuaacacauuauguccguauaagugaguccgcaugcccaguaacuaugcaucuugauaauaugccuacuaaaguguuuaauucauuuuaauaagcccuguuuggggaaggagaguuccuuggagcagcucguuccuccuugaggcaccgagucacauuucuguaugugccuacaguuucugcugaaauauuucagaugagcuuugagaguugagccgauucaccagggcuagacugcucuucuuguacagucggagagccaagcagagagcuguuuggcuuccucuggaagcuuugcugcaguggaggagccaggguugucagucacccgggcacgacagccugugaaguagaugccuccuuaguuggaaucaucucuuuuuacucucuuacaggcugcuuucccaaucguaggaaaauuuacucugaagggaggaaacuuuuaagucaguguuuucuccuucauugaugcgaauacaucggugcacauggcucugaagcaaagagucaacaauuuuugauguuuucuguuauuuuucuucugacaguuuacugagaauuacuuacagagagugugcucuguguagccgauucuuucugauucacgauuuuucuccugggcagucuucuguuaagagaaggcuuuuagauuuuaauuaggacaaguuucacagcauuuaaguaauuguagucuuguuaugauacuuaaagauuuaguaaguaguuaugaugcagacaaaauugaaaucucgcuugaacauuuaaaacuuugcuugccauaaaauuauuacuuuguuguuuauuauacuuucuuucuucgcugaccagugaauauuauguagcuguuuugcuaaauuuauauuuaaacacuuuaaaaggguuuaugacuugucuuugugacuguaauuugagacccugcuuugacagguuugacgaauagguuucuuugguuuguaaauuguacagaaugccaggucauucauuuuccccaaagcaaagcacccuggcuaccucuguaauaaccuucaaagagaagugagaugcuugguauaaaaaugugcuucaaguuuguuuuguguauaaauggcaauguuauugugaaaaauugccuccucugucaauuauuuaacaguuguuuuagugaauauaaucuuaccuuuuuucaacuguuuucagaguaauucuucaguccaguguucagagcuguaaaaccccugaaccuaaccuuucuggcagugcaggcauuacuaaacgaaccaccagaucugcuucggggaaaagcaguuuuaaaaggugagaaaagucucucauucuggcaagucucauguuuguuuccaguucacucuucuggacccugcuucuggagacugacaugaagauaggaaguuggaggcucugugaugggaauggaggcugcuguguuaacuggcuuuucagagcaaauaccucuuguuggaaguguggucucuggcaugguuugauauggggaagcugagagaacuuugccuaagugcuuguugcuccucuucucccauaucagauagagcuuagugagucauggcagagccucugggcucucaaccugaccacggguucuccugccgcggugcuucccgacaccugccacugcucuccccuuuaucuccuugguuguuacuucuaccuacucuaggcucugagaauguucuccaccaucucuggaugucugucauaaaccaaagucagacaugucauucucaaguuauuccuagacccagccccugccaagcaaagaaaagaccacaccauugcuccuuccugaccugugaaaagcagcugccuugaucaugcuugggcaccaucacuugacaggggugacuucacuuguuuuuguuuuuuguuuuuuguuuuuuuugagagagggucucuuggugcagccaugacuaucucauagaccugcuuaccucugccuuccaaaugcugugauuaaaggcaugcaccacuaccauccaucaauacuucacucugaaaucggauggcucugaagaaaaacagggccagauucuacauucuacuugacucuuuuaucaguucuuguuuguuuguuggacgcuuucucaccuucaugacguaggucauuguaagcucauugaugugguccaccaucacugucccaagagcucugggcacucuggauucuaaggaaugcuuuugaguuuuguuacuuuuccuuguugcugacuuuauaacauuucacuuuggagugagagccuccugagaacagaaaaaagaacaaccuacguggguacuugagaaacuucagucagccgcugacucagaaaguugggauuugaucuuaaggauuuuauguguguggaguguugguuaccacagaagccaggaagcauuauuuuuaauuagauauguacuuagguguuuguuucuuuuauacuguaguuccaacuugacaagaaaaguaggaaugggucagauuuagguacacuauauaacauaguaucugaguucugacagaaaaauaggagaugggccgaguugugcccauuuaauuucauuaauuaaugaugaaucaggaaccauuuauuuacugauugacagugcugaugcuggaacucaggguuucauguggacaagacaagugcuuuacuacugaaguaaauaccaacccgaguuaugucuuaaaagauaauuuaaugacucggauaaaugcuucugaaacaaguaagauaaauaaauaaaauuccuauguaaaacuucugagcuaaaacuccaguuugaaaguauacacuauggccgggugugguggcgcacgccuguaaucccagcacucgggaggcagaggcagguggauuaaugaguucgaggccagccuggucuacaaagugaguuccaggacagccagggcuauacagagaaauccugucucaaaaaaaaaaaaagagaaauuauacacuaugacauauagagaaaaguguaucgucauaauuauuucaauaugcaaauuucuaauuaugcauacaauugaagcacaaaaccccccaugcuucuugauucuucuuggugugacuguugaggcuuuagauuccaacuuuuccauuaaguuaauaggaaaugcaaauaccuuuuaugugcagucagacugucaaaaguucccugugaaugguggccuuuaauuccagccccuaggagacagacagggagccuggucuacauagcaaggucuaggucaaguagggcuauguagugagaccuugucucaaaccagaacauuagcugugucagaaaguguggugucaguguugauaucuaagugcucgagcuuuugguauaauuaauccaguaagucuugcucauuugauucugagugauagaauuuagcccaagcuuugaacgacaccaugccuauuccaccgaggaagguugacuaugcacuacugauccuuauaucuagguuucuuggcugugcauggcccuccugugaccuccacuuagccucccuggauagugguuucugauuuucagugagcuccuccugagguccuagauuggaugcuuugaggauucuaaauaagcuggguuaaaugaacuggaccaaagugccuuuccggaauuugggguagagauaagccaaagagauuuggaaguugagguaggaguacuguggccuauauucauaguacuuuauuaucacuucuagccuacaaaagaaaggcgcacgacugugcacggcauuccaccacuucuaggaaauaaggagaaucagagauuuccaggauauagccugcauuuaaccugcugaauaauguucagcuucuguuuacaggguauuaaaggaaugcccucuauauaccauuaacauugguauauaaucuacuccaggaaaaauaucucagcugagaugauuggguaauucuaacauacuuaguugaagucucuucucuuuaaacaauagcccccccuccccccaaaaaaagcacaucaaaacaaaaauuacaauuucuuucaaugucugucucccuucaggcucaccaggccuccugguucuuuugugggaaagucccucucuguuccagguccuugcacucacacaucuccugcgauggcaacauuaauguuuaauccccccucccacacacacacacagaggcuucuaggauggagauucucgccaaccucccuuugcacugaguggacuccugaguuuugacauuguaucaagagagacuucaacuuucagagacuuucccagcaaaaccucuuaaaagauuggcuacuugcgcugagaaaauggguggauuaugauagaggagaugggcggauuugcuguuggaggagaaaaaccacugugcuccuccuaugagauggccuucuugucuuaugucauuuggauggaagccacaugcauucagaaguccuggggcuucugugucggagcacacagcuugugugggauggagucguuugguuggugcuguguuucucauuuucauuugucaggcucugaaggaaguucguggguuucuacaccucucacuuucuacuaggaccauaaaucuauuauaacagcucauaacugacauaaugaauuggcuuuuuuccagcauucccauacuaacucugaagcgcucucucagagcaagccuugaacacugucacaccgguagagggcuugccggugccuugugugggccauucaccccaguucacaacucuuucuguagcucuuuacuccuguguuucuggaagcuuguaaaguuucuuuugggccaucuuuucuuuuuccauuauuucaucccauuuccugaaaaaucucucuugucccaaugaccuucuuuauauuuaagaugcaucacucugcuucugccacgauaaugccuguggcuccgggaaacuuguacuuacaggugugaugcucaaggcccuucauugcuccaaacucaugccuugcgaccaucuccguggagugccugccuguacuuccugggcuuucucuaaguccuugcuguggaauucauuuccgucuugccugucauugcaucauagcucucugggccucagcuccugguuucuguuccguugcuuccgggauuucauauuucaucggccauuaucuccaggaaccccaggauguucucccucuauucuucuuaagcuaacauccuguggaauggcagauacauuuccacuugacucgacccagagauugucuuugcacucaagacucucugcuccaguguguaaaaacuaugcacccaguucgggucagucuucgcuuuccaagugagggucgucuccggaucagaaguaauuucauagguggguuugucuuuucucauuuguacuuucuucuuuuccuuuuucucugaaaguugcuaaugaguuugagguauaacagcacauugugggagaaagaaagagaggaagggugaguuagguugauuuugggugagcccagaggggcccuuggcugucccugcccagaucucuuuacagacaggccaagugcuccaagaggaugggccuggcucgaaaccacccaguaauuccucuuuaucucuuccuucucuccucuuuccccacagccuggcuccguggagggagcggaggagaaggagcgcuuugcagcaaaugcccaugcuggccuuaugguaccugccuugcucugcugcccaugccugccugucuuuguuuauuucuauugcuuuuuuuuuccccuccuuuaaacaaaauuugaacuuuucucugcccugccuuucucuccugucugccuuuuuaugguugauguuguauugucucuucuaaaggaugccauuaaaaaucacaccuagugugugcuuuuagcaugccgauguucuccuuguguugcccuccuugucuuugaaauuuuccuaaggaauacuuuagagucuucaugguaaaucucucucucucucuuuuuuuuuuucuccucaguccagccauuucaaggacuaagacagucuuacguuaaaguaaaaaaacggugaccagcacuccagggaagacuaggaacagaaaacccaaaaaggauuuagccaaucaaucugagaacaaagcagacucugcaauggccuuagcuucuuaccacauaagaaguucauucaaugaagaaaaugucacuggccucucauccacucacugacucuggggugugguugaaccauuugagggccugacucucccuuuuguuaucucaaguuggacaaaagcugcuguugugaacuuagucucaggugucaauauccuguccucugccaccagagaguugucuggugagugugguacaugugugugugucccugugauggcaaucauguuugcugcuggccuccagaagaguugaggaucugauggagauaucuuagguauuuauuuuuuguucaaccuugugacccugacucgcaguuuauaaagaugaaagagaugaacaucccaccagugguacccuccaucuucagguaugauuugguacaaucagcuucacuuuccucuuguuaauccuguugugauguucacugugugaaguacccaagcugcuuguuuuucaccaaagagugcuuuauuaacaaccugugaacacugcauuuaaacacuguuguauguuguugugguuacugaaaaccugcuaggaaauguugagaauguuggaacccuuucucaguuaccugguuccuacaaauccuuccuugugucauuuuaggaugaagauuucagagcugggauguuguuggguugcucagccacguuauaauuguguuuacuucauuacaucaaaaccaaacaucaacccuagcauuuuccuuugggaaagcauccuaaauaaugguggcuuuaacaacaaaauugugagccuugcuguauuggcgcacgccuugaaucccagcauugggaggcagaggcagguggaucuccagguggaguuccaggccagccaaugauacacaaggaaauccugucucaaaaauaaaacaaagcaaaacaaaaaaaccaaacccaaaaucccaaaauuguuaacccuuuguagagucuuucucuguaacgcuguggaguuuuuuccuugugauccacaguuugauuuuagugacaaucacuugcuucuggaguuaggcuguuuguguaagagaucucacuguugccuuugguuagggaauaugacuagaaacuguagugugccuuuucucuucacccugcuggaagccagcagcacccgugccaugaagcaauugcaaaaccagaauuuaucugcugccacaaaaaaaaaaaaaaaaaaaaagacagagcccauaauuagaaaauacucuauaguugucuugguuacuuccacaauugaggcuaaugguuuuuugacucucccaguuuagaaacuggagaaaugcaauauugaaagccauugacagccaaugccuucccaagacaggugaaugugucaggugagcaggcaaucccacuugaaaagcugccuuccuuguaguugauauugacagguuaaagucuaguuaauguaaaaauauugaaagacaauagguccccccuuucaguguuucuauccucaaacugcauugguuggccuuggauuggaggcaugaggauucaauguaaauccacacaaagagccccccuuccuaggcagcacguagcuuucaaacaacgggaaaaaacaguuaagguaaaguuuguuaucucuggauaugaauuggauuggaucuagguaggagggcaaacguuucauuuaccaaucaugcucaaucaaacugccuaagucuaaaauagaaccuuccugggugguucuuccuucccugaacaagcuaggccaggcaccaggagacagaaggagacuccauuccaucugaacuaagcuagauuuguucgcauggaucagaaugaguuggucagggccugcccacacuggcucguggucugcaaguuugggaggaaaccaccugggcuucagagaugaccacagugcuuuuuaaaaggcacuuuuuuguguuugcagcuccauucaucuagaagugcugccacuguggcucuucccugcauuuaacucccuugcuaaaguuacuuaggaaacgugaguuggugaggacacauucauuucuaggaaaagcuacuugauguugucugggcaggacugcuuagcaacugaccaccagugacaucaggacccaggaagucuuugaucagacuaauggaaaguccuuccuguugggaauuaguggacaaccucuccccaaacuacaacuacccagaaacuucugggauagaagacccuguagcuauaaagcaugacucaguagauaugggauggaggggccccuuuaacuuaagaacuuuaaaugccuuuguaagugcaucaaagcuucuuccagcagaaugaaaauuagaaaaguauauuuauaggugcccuugacgcuuuuggggaacgcauacuauccagagucuaagagaagaaugucugcauuagcugagcugagggcuuauagacagauugucuuaggguuucuauuccugcacaaacaucaugaccaagaagcaaauuggggaggaaaggguuuauucggcuugcgcuuccaugcugcuguucaucaccaaaggaagucaggacuggaacucaaacaggucagggagcaggagcugaugcagaggccauggugggauguuccuuacuggcuugcucagcuugcucuuuuauagaacccaagacuaccagcccagggaugguuccaccuacaaggagccuuucauccuugaucacuaauugagaaaaugccuuacaguuggaucucauggaggcauuuccuuaacugaagcuccuuucucugugauaacuccaggugagucaaguugaaacaaaacuaggcaguacacagauuaauacaauucugaggcccagcuauaacucuugauuugaggcaagaaggacggacccugaguagugccacaaucaaggguagcaguauuugucgaaacuaacauggccacaugcugcucuuccucauuaacuccccagcuuuaauugguccccaaaaccuaguucuauccauugcccugcccugcccuacugccccccugucggguggcuucuaccucuuggcuugggcccugacaggucacaggggcuuccaagcguucuccugaggcucuuugagcacaaucaggucugucgaccuuuccagcuuucugggucuggaauuccucaggccuuuguuagcuugaauagcugucugugacaagugaguauguguucuagaaacaucagcuguuuuuccucacauauuuuuuuuaaaaguucuuacuugcauuuuggaaagcaguuggucagaaaccuuaaaaccuauuuuuuuuuuuuaagcugggcaauuguagcaggcagaucucuugugaguucaagaccuaccuggucuucaaagugaguuccaguauaguuagagcuacacagagaaucccugucucaaacaaaacaaagcaaaacaaacaaacaaacaaacaaaacagauaauacaaacuauauuuuaagauuucucucccacugaagugaccucuugagaauagccacuguucuugcauuucuucauaaaucugaguguuccccaucucacugaguggaaauacuacagauacauuuaaaagaucgccuauacuguguaagaaauuaccuccugaugauccaguagaacucacuguggauagacacgucugucagauuacgguacugcaguuuuacauccauuguuugaagacuuuauuguacacucaugugcagaugaaguuuuaaaauguuacugacgagucaccauuugaucagucauugucuugauauuuuauuaaauuguauauuucuaauaauauuuuuuaaaguugagagaacugguuggauguuuauucuccugaagguauuuuuaagauaaagcuucaccauagccuguaaacuuggcacauaaguaguuuuugauacuuuuuguugcauuugaaaaaucuuguguauuguaaaaugguuuuauacaaaauacuaaauaguagaaauuguauaauuuacaaucguauaauuaaaaauauuaaacagucu

SEQ ID NO: 12503 - RNA, 74789 nt, Mus musculus
aauagaccuugauuacuuaacauuuuuccuuguauacaauaucucuugagaaauacaaucgaaugcuuuauggaucuaggccuucagaaaaauauuuuuauugagaaaacuuuauuaauaccuuccuuaguaccucccuuggugguucuuuaaaaaaagaaaacaacaaaccuauuuugaucacuaagaauccucugcuacauacuguuuuuaaauccggucuucaauuaacaaguuguauauugaguaaauaaauggacuccuuugugaaagaaacaauaaaaauaacccugauuuugcucugauauuaaagcuugaacuaucccuauagugggaagaaaauuauaauaaaguuaaauaguaagcuaaucaguuaugcaagcuaucccuuaguuuauuuuaacuuaacccuugugaauacuucacacaaaaauacauacacaagagcaaaugaacuauacaaacuaaauauccagcagguaaaacaaguacaaauuaaaagauguguaaguuguuaaguggcugauuagguuaucugcauaaucaaagauaacaaaaaccaucuuagaagugacaaaaguauucuagcacuucguuuaaacauaaaagacaucagcaaucuauaaaauggucaaauggguaacaugcaauaauugguacaaugaccaauaauauuuauugaauuuaaacuauuuacuguuguaaacauuuuaacaaaagcaugagaucuaaauacagucuuugacaauuccaacaaaauaagugguauguuuaaaaaauaaagcugaugagcaauagauucaucgauuuuauauauugucuuucaacaguuccagaaagaauagcacaguauuuuuaaaaaguauacagcaagauuguuccuauuauaaugucaaacucuggaaacuguaaauacaaagaaagucagugaacagucaaauggucauguucauaaagaagaaauuacaguaauaacugucugcgauccaguuaaauucuguugucuauagaaugcguuuccuugucaguugauuucauaguuccuuuuccaagagacagcaaaacuuuggcaauuggauauacugaaaauauauuuucaaaguucaagacacagucagucauagcauuuuuguuguuguuaaggguacaccaaggcucagaguuugguagagauuccauguggaaaaagugcgcaauauucugcacagauagcuuacaaaggugcuggcaguugcucuucagcagaaucuuggguuuuugcuugcauagcucacacaucacuggaaugugggaaagugugcuauuuuuuuucuuucucuauuuuuuucuuuuuggcaagagcaaaggagacaugauggugugaauuaccacggugggcauacugaauccacgcagaacacaggcugcuaccugaugucauugguuuuuguauacugguuuuguuuuuguugaagcaguucuguuaucgccagaagcuuuuucaguacgugcuagacacaggagaaauagugaggaaaaaaaucacuaagcaaauaaagagcuuaaaauuucaauuauaggauuuauuacuuuugauaaaaacuauaucaaaggacugagauucuacucaagacauaaacugaguauuuuuaguuguaaccaaaauauagaaggucuuacuacacuaaauuuugucauuauuaaaucuugaaaaaucuaaguuaaacaauagcaauauuuuccaauuguacucuuaacuaguuaggacugcuuggauucuagccucgcaggcuaauuaaucagacuuaggauggucuaucuugauuuauccuuuccuaugugauacccuuuucucuccauuuaacuaccuuagcuuaagagagacuaucuccaguaacuuaucacuaaaucaauuaaaguaucuuuacaguucuacuggacagcaaaagcuuaauguggacugauuuuuaagguaugaguuauguaccauaccaacuugaaucacuauaauaauguauccucuguaguuauuuuucacauuucuuauauaguucuccugugcuucacaaguaguuuugcucacacacuugguaugagaguaacugaaagaguaccaugccuucuuacuacugacaguaacucacuugccauuuuuacauguaccauuuauaaagcaggaacauugccauguaaaaccuaccugcuguacaccacgcucauugcugaguguucucaguucaucugaaugagcuacacaaaucucaugcaaugcugcuaagucacgagacaggucaguucuagaaugcucuguaguguccggaaguucagguacauucuuuaagggaaucauaaaacugcguuuagaaauaaaaacccuuguagucucuucuaaaguuauccuaacuagguauaaaacauuaauuuguacaaaaauuuuuauucaaguaauucugcugaacauggguuauaggacaucuauuuacaaagaagccagguucuucaacuuucauagaaugacagugugaaucuuuuuuaaauuuagagcauaugcaaaauaaaugauaccauuacaacuuaaaacuccuagacugaauacuacuacaguacucuuaucuaaauuaaccaacaucuaaagaacuaaauuaugaaaguauaauaaaaauucauuguuugcaauuucuauagacugugcucaagauaauucuaaaauaugggauuauuggacauuaacauguuuaaccuucaugaaguaacuuagccaucauaauaaauguauaauaccguauuauugcauuaaaugccaauaauuagaaguacuccuaauagaaucuuugcagaagcucacauaaauguuucuuauaaauauagaacuuauguugucggucuuccuucuaaccccauuuguuugccaaaaagggcuuuugacauuuguuuuaaaaugaaucacugagucgaaauacacuacuacaacugaaucgccuauacuuuugaugacaaacuuggcuaaacucacacaugcgugcuaauuucaccuuggucuccguguauacauaccacauuaugaauauauuuacuuaaaaauucauucaguguuagaaauguauaugggguagaaaauuuaacuuuauuauuuagggucucagaaauuaugaauauguucaauuuuguaucaguuuaauuuauaaaagcucaagugagguauaauaauuauauuauuucauuuaguucuaacuuuaguuccaauauaaauggcuucaaaucuuguuucagcuacaacuuaaaagguuacuaaauccaacaauagcuaaaggguaugaaugaaaagacagccugaaagaugacugguugaaagccacaauuguguaugcuugauauaaacaagaauaagugaaaaagacauuuuggauagaaaagauuuuauuuugaaguccugguuuuaaaauuuaaagguuauuacucauauggcuaagcucauucucaaagaacuugaaaauuauauacauaccccaaguucaucuaaaaacaugaucaugcgauguuuauuacuuuuuauaaauggauugacaccuuccauauaaggcuccuaaaaaaauuaaaaacuuccauaaggcuccuaaaaaauuuaaaacuuccaucucauauaccuuaaaagaacuguuuuacaacaaaaacuauacauguugcaagaauuaguauuuauucaugcaaaauuucucuuuaauauaaacaguuucgugggaggaauggagguauuuaaugaagauucaaaauuaaauuacaaauuaaaaaucauuaaacauauagcuuggcagacccaaauuguuuauauauagauuuagaauuaauuacugauaaauuaugaagaauccaacacauuauaaggaauuaaauaaaauacagugaaaccaaaaacucccuaugacugcaaaauacgcuuuggguuucaggaaauuucaaacaauaacccauaaauguaaacuacuuaaacuaaaauccuaacccacuauaauuuauaauuucuaguuaguaaaguaucaacaacaggcuucaaaugggauaacauucaauuggaaaucccaaagauguagacaugaaauuggaagaacaacaaugaaacacacgaacacccccagcagaugaacagagauaaggaucugugggcugcugagacgccucugcauuaagagcgccugcuacacuugcagagcaggaccagggcucacuugccagcacucagauggugacuuacaacuguuauguuccugagaauauaauauaauauacucuguccucuucuggcccauguaggcacaagguacauaccagugcacuuaacgcacauacaggcaaaacacucauacacauaaaagugaauaaaucuuuuuagaaaaaaaugaaucuggcaagaaauaauaauaaccaaaaauggaaaauggaauauaugacaaaagccugaaauguauauuuaauuauuaaccauaccccaaaguuuaggacaagucugaauggaaguguaaagaauacuuguuacauuugaacaucaguuaaaggacugcauacugacuagugguauguacaugugaauuuaugaacaaauaugucauauacuaagucacaaaagcagauaacuauaucauuccaaucauguuuugaagaucugguauauauucauugugaauuuaaauuuccauuuaaaauguuauuaauuuaauuaucaaaauauguuuaccuuagcuccaaauuccacaagauuugcuaaauucugcacagauuuagccacuaaugucaguguucuugcagcaauaggagauggggaaucuagaagaaaauuggguauagccaaugacaccgacuccagagguuacuuucagauaaauggucaaacacuuaguauuaacacuaaagaaauauuaaaagugccaacaauccuuuauucagaauauauucacaauaguccuugaaaauauaucacuuaauucaaaagaacuugaauuaaaagggaaaauugaacauacuuaucagugcuuguuuugugaaaaggaaacuaaaggaguaauuuccaacuggcugauauuucagaauacuucaaaaagcugcuuuauugcuaagaagacucucacucuaaaaacuuucagaccaugcccaaagcuaauucaacccacauaggggagcauuuugcaaucuuagcaauucccuguucccaacauuauuugcaggcaacuagcucaauuuauacaucaguuuuugaguucaugaaacaguucccuguagaacagagaaaauggaauguaaaugaaaaguauuuguagcuaccaaacagaaacugacaauuaaggccccacccauguccauggacaaccuugaguuucugaucucuuaucagguacaagggguugaacccagggccucauguauacucugccaguguuccaccagcuuaguuacauucucagccagcaacuauuaacauuuugacucacuguuuuguauuaaaguggcaguuuaaggccaauguuuagauagagcgcucaaaaauucuaagccuuuuaauuuuaaaaaaguuauguauacuuugguguggguauguacaaaugagugcagcuacccacagaaccaagaccagugucugaucccuuggagauggagucauaagugguugugagccaccugccauggguguuuggaagugaauucagguucucuguaagagcaguguauguucuuaaacacugaaccauuacacccagucuuuuauucuuaauaugcaucauuucaaucaccuuaguauuaauaaaaauugcaggaaugugaggaguauaaacauaauaauagugaaaaaaacuauggucuucccuuugauuuuaagaucagggggacucuuagacucaccauucaugcauaugggcauuguagauacauaccacuguguuuagugacauagucuggcuacaaagcccagguuugucuugggcuuuuuuguaccuuagccuccuaaguucugggauuacagaauuccagaaugaagucccaccucaaauaaauuuuaauacagauuugagguucaaaguauagcaugcaaaugacuguuuccuucuauuaauguuaauggacucauuacaacauuagaguaagaaacaucaauacuuuuucuuaagcuuacaaaucuuaaaauuuuguccuguggacagugagugaaaagcaaaauggggucaagcuuauuaaaaagaaucuugggcuaucuuuguaaguguucacagauugcuaauguggcugcacauaggucuuuaaccugaucuuagcagaaaguuuaccuuacaguaaccugauguaggcaaaggacacaagaacaagagcccuuccuaaucuccuacaaacacuugucagagccagcaggccagcaagagugguaaacgugcuugccaccaaguuugauguccugauuucaauccuaggcacucagauggugaagagagacagucaucucccaagagcugaccucugaucccuacacaugcuccauaacaagcaaaugcccauauauacacacacacacacacacacacacacacacacacacacacacacacacacgugcucaagugacuacaauguagacuuuuuaaaauaaaaaaaaugagucacaggacaaaaaaaucuuagauacuaaaagacaaagcaggcaaguuuuauuuguaucuugaauuuuuuuaauuugauuuaaaaggcaaguauuuuuaucaaauaugaaaauacagauuuuuuucucauuugaaaauauauuaaaagguaauuaccugagaugauauuaaacauccguggauucaggauagcagggcagauaaggcgaagaaaaacaaaaccacuaauugaaagaaaaaauucuuuuuagaaaacuuacauuauaaacaaaaaacuuaaacuuagaaccauaacauuuacucucaacauagggaagccuaaacgaaguuauuaagaaacuuauaaagcaaacuuacagacuaacuuuggaaaacuugcacauaaaccucuuaccuguuuauaguagauuaguaauucauuuucuacuagaguaaacaguuuauuaaacacauugagauuugcuguaagauuaugaagagugaaauaagccuuuuauagguacaugcuguaagguuucaaaucauccacucucuugucugucuuuugaaguuuauuuaaacaaacaaacaaacaaacaaauccaugagaguaaauuaaguugguuauaucaaaacugcucacaacuuauauaaacaguuuaauacauugucauuauaagugacaccugaaccaaugaaaauguauucaguaaacacucaaaggcuuucaaugauacuacaauuuuuuauuuuuauuuuuuuugguuuuucgagacaggguuucucuguauagcccuggcuguccuggaacucacucuguagaccaggcuggccucgaacacagaaauccgccugccucugccucccaagugcugggauuaaaggcgugugccaccaccacccggcugauacuacaauuuuuaaaguuuucuuuaaaaguuguugaauuucaaaguaacagaacuuaucauggcuuaucaacaguggcuaugguugacaucaguuuuacuuugagaacugcaguuaguguaagcuucaauagauaucccacucuguauauguugucauguaagaucaauuucacuucuuaaagaauacaugguuccccauaguuuugaaguuccuucuacagauuacuuacaauaauuaauaacucuucacauuaugauuuuucccccauagugaagguuccuucauaagguuuucugaagcauuuugauacuuuaguagggucugggaacuaaaaaccuaaaucucagugaaaaaaauauuuuuaaauuuuuaaggugauuuuaaauugaauaauacauggguacuacacaauuuaaagaugacuaggaagagaaaucaccucaggcacaaaagccucuaaaguacacugucauuauuaauccaaccagaggacucccugcuguauuaguuuaacaguuacacauauuuaagcacauuuaaaguacagaacaguuuauuguacaucacacacagcugcugaaauacugugcuuuucauuuucuucauuccuacaauucuucaguaugucuuggcacagcuacuugaguuuugguuggcuguuuuauucagcgguaggaaucaaauccaggaccucuuaguguuaagcuaguaccccaccacugagcugugcccucagggcacuauuagacauucugccuguaagaaaaguagaauucucuucagagaauuuacauuagaaacaggucuuuaaaacucacuuuacauuuguacauauacuguguauuuuccauaauuacuagaaaacugcuguauuugauguauuucuauuaaauuucuagucacuguguacuagcugagauaugcuuaccaaaauguuugaacaagauuuuuagaugguuuuagaaauuaaguuuauaacucaagcaaacaauguaaucucuguagcugugcuuccucacuggagagugauaaugagugccaaagcaguccuuaauguccuaugagcacacugaaucacagcuucagaauuacacggcaaggcuggagaucuacaugcuacaaacgaauuaaaauccagaugguucaauuacgguauuuccccaagcaacaaguuucuguauuuuugccuacauaaacaaaucaaguguguguucuauacaaugucuaugacaaaugaaaaagugacucuuaccuaacgacucuuguucucaugguguuauuuguaggccacuuaugcugaacugauuucuguaaacacccauagauauaucucaguguccugccaaaauaacauaaaugucucaauacagaaaguaagcaucaucauaaucuaguugcaacuaaaauuuuaauuuacccaaacuguauaccauauuuuaaugcauuuggguuucucaucuaaaaaagguuuugucaaaaguaaugagaaaaacauucagugauggauauagaaacauaauccaguaugcuuagcucaaugcauuguaaauucuguguuaaugaaaaguaugaaacaaguuauuagaaaugagaauagauuuaaacuucuuuuuuuguuugcaggaaaucuaaugcgaggcaagaaauaaccacuaaauuuccagauacuguccccagauuugagacauuucaaucacucccuaagcuaaaauauaagccagacuuacuugguccacaaaaacauacaaucuaauuuguaaauacauguuuuuaggcuggccuaugcucuucuugacccaaccucuccaauacugggauuacagacaugugccacaaugccugugauuuuaucuagcuucuuuaacaguuauuuuacucauucuuuuacucucuuucccuuaaauauaauccaucuuuuaaggacuaaaagucugaguauaaugccaagauaauaaaaaucauucauuaaaagacaaaacaaaaauuuggcaacuuacgguggaaguauuucugaagccaugaauauuuucuccacaagcucugaaaguaugcucaauaggugugcuaaauuaguguucacaucuucauuuuuuucuaacuuugacggacuuaacuaagagaaauacaaauuuauuuuuugugaugauugaauuucaaguaaauugugauaagugaguagucguuuucaaagcuguuaccuguuccacauauacaaaugcaguaaguuugcuaaaauuaguuucucaacuaauauuuaacuacucaguucuguuuauauaagaagaaaagcuguuuuuaaugagguacaacuuaguggcuaaggaaaauaaucaaaauauauuaaguaaaaucaugacccuucaaguacaccccuccuccccaccauccaaguguucuggucugcuagauuuaucuacaaauaugaaagcuaugucagcuuucauaguaaggguaauugugggauuacccucaacuuaagucacucauuuuguuguggcacaauuaacauuuuacagcuccaaguguugaaaaguauuucguuauuuuauugacacuauaucaagccuaaaaauguauacugucuuucuuugaaauugcucuguagcauucaugaaguagaacagucauguacgagugauucuacucaaugguaugggcugccuauaaacucacagugcaaccuuaaucaucuuuaaaagauuauuucaucuucuuuuaauccccaucuucuauaaaauaacccagaaaucccucuagagagaagauguuacaacauauuacucaagguaagcccucuugaaguuugacuuugguugcugacauggcauuauccaugugggaaauuccauauccaacuucacaugaugugcaaaccauaacacaagccuccaagaauucauguaaaauuaacuucagucauagacuuagguuccauucccaggauacuuuauuguauauaugaaaucauccaaauguuuuaaaauacuucuuuuuuuccaauaacagauacucaacacguacaaaagucucuagaaaaguguucaauuaacguuauacacauucucucaaggcaaaguauguuuggucauuaauauaauaaaagaaaugcucaaagagcuuuguaugugcucaaggagagguggauuauaaauauacuagagaacacgauuguacugauacaucucagaaaugauguacuuuccuaaagaugucauuuuuuaaaguucucauuaaaauaugcuauuugcugcaaagaauaaaacuauaaauucuuaccucacaugauugcuugcuuuccauaaucuuuaaaauggagucuuucaaagcaugaugaacaaacuguguggcaguagcuuucauauacugcuccaucaagguacuugcaaguguuguagcucgaaauaggguaguggcuucaucuacacaaaaauggauguuucauuguauuuacagaacuguacuaauauaacuacucugaaaauuaaauuaauuuucuuuaguaaugugcuuuuuacauacauauguugggguuaacaugcauuaaaucaccugaucucagagugaauuaaaucaugacuaucauaagugagaagaaaaaaacaccaucauguucauaugaaaagauucaaaauaguucuccaguguguugaacaccaguuugugauaaacacaaacuuucuacugauuucauaaccaaaaauaaauuacuucaucucugugguauuuugaguaagaaugguccucauaggcucaaauauuugaaugcuuauuuaccaggagugacacuauuugaagauuagaaggguuaggaaguuugcccuuauggaggaaguguugucacuagagaucggcuugagguuucaaagcccaucuacuaagccuagagucucucucugugccuacagaucaggauauagcucuuggcuacugcuacaguguuugccuacaugcuaccaagcuuaauacugccauaaugauaaaauauuaaaucucugaaacugcaagcaaggccccaauuaaaugcuuucuuauacaaaugucaccagauauaaaaaaaaauauguaccauuuuaucuacuccuugacaaauuaauuuuuguaauuuuuaugguuaaagaaggcaaggauugucaccaaaucaaagugcugggagaaaauagauuaggaaucugugaaaaacauaguaauauguuacaguggccuuggaacugauauagaauguagaaauaaaauacacuaguauuuuaugacuucuacucaugaguuacuaaguacaaacucagguaauaugauaaauauuacaccacuguugaucacacauauauuaccuuccauacuuaucucucugucauuuagugugcauaacaacaaugauucaagcuuuucaugaagaaauaucuuuaguaggaugcuggccaguaguguucggucuuguccacauacaugugauaaagcauagacgacaugaaguuccuuuugcaguauaagcuaaaagugacauaaguaaagacugcugaaaguacacaacaagaccaauugaaaaaacauaucuacugaauacaauuguuaaaaauugacuuuauauuccuagucucauuaagaucaaaaucacaguauguguuuuuuacaucuggcuucuucucugccauuaauauaggguguuacuauuuaacuuaauggaguuuuauuaaauaguaaauauuucuguuuaguaucauuaaaaacgauuaaacuaguaaacaauaccucuuuaaauucacuguacucuucuucuggcaugauuuuuuccauggaguaucgugcucgaacacgcaaagauccugguucaauaccuuuuagugguauaugggaacuuaguagaaaccauucaucuguugcauguccuuucuguaaccugcucaacuggcaacgcauaaauacuacaaagaaaaaaacaaauuacgauauuagaaaaccacuacagucacauaauaaacuuuucuugauaaucccuuucucuaguuuuaaaugcuguccacuaagcagguuuucaacacuaccacaaagucaacacuucacuuuuuuuucuucacuuacugaaggccuguuauguggcauuuuguaguaguaugggaacaugggauugugucugacaugcaugcaaaaugucuuaagcuaucaaagaggaugcaguucaagugcugcaacagugaauaguacuuuuggacauaaggaugaguaaaucagccuaggagaguuaaaagucucuuccaaacagaaaaguauguugagauagcuagugagguaucaagggagaggaaugaagaccacauccaaauagaaaguaugacauuuuucugugccauuacugcaauguuaucauauaaguaauggagaaaaacauucuuuuaaaaagguaugcaauuacagacuaaacauuuuauucagagagguacaugucauuugaucuggcauauuacuguuuacccuaaaacccugaauuguaagaagacauaaaccuaagucaccccgaugugaaucguuagaucacacugucaucuaucuauccuaucaaaaauguacugcuuagaauaggaucggagcaucugcuauuaagcaccuaaauuuucuguguauguuuuuuuuucuuuaucuuugcagguuuagguuuuaauccucagcaagcuagacaaauacucuaccacugaguuacagcucuaguauuaacaguaccuuuaauaugugcaguguaggaaaugagggaacacuaaaaaaguaaagacaauaaaaaaauaaucaccacuaccauuuucucaucuuguucuuugggaacaggaaagugggcauuuguauauuuuaaguuguaaggacuuacaguacauacacuuuagucguuuuguuuuuucuuuccuucauaaucccuucugaacaauauuuagaagcaaacuguuauauagcauguguuucacuuccauuuugacacauaaauucuaaaaauauauacaauaugcuuuuauuacuuuagaaagcuucauauucaacuuacagauaucuggaucuuugcuuuucuuuguuuuauuacuaagugugauuucaaaucuauugaugucaggaggaagaucacuaaagaagcaaggaaaaaaauuagaaaaauguuguaguaucaaacuaccuuauuucuuuuuuaacaguucaguguguuagauuuaaaacaggauuaauaauucauuaaaacaaaauuaggaaauacagaaagcauuuuguuauuguuuuugaguaauucaaauaugaaagaagcuaagagaaaauacuauuaaaacaccuagaaaacaauagaaacuuaaacagauuauauauaaacaguaggaggaaaauguaauuaugauuguaaaaacugauugaauaugacaagauaugacuuacucaaagacaaacuccucugaccauacuggguuuugccccucccuugcaugaguuuuugcuacuuggacgcuauucaaguagauguuacaauauggauuaguaaaguguuuuacugguaguuuaugggcuucuucaauauguaaaacaaggcugcugaccuaaagagaacacaaaaauucauauccaacauuucaagaccugaauaugaggcuuuuaaauaaaaaaaaaaaagacuuuuuuccuuaauauuuaaaagaaaacauaagcuuugcuaaucaacuaccaucauccaaaugaaaacuacaaacauggaauaaacaugcuuacauguaauguacaguauaagcaaccauaugcuuacauuaagauuucacuauucuaguaagagucucaugguuaagguauucuaagacaccaauuuuaccuuuugacauuucaaaaacgacaguaauuccaagaaacuaacuuaucaccaguuugggugccuacgacaugaccacuacuauuguuuucucuacaucaguuaugucaccuccuacaagucagucucggagccucuccuuuuucauacauguagacgacuauauguuaaugacugggaacaauccauagccacacagcagaggaacugacauauccaagggauucacgauauuagcucugauuuuacauggacaaauauaugugacaauuucaguauauugaauacuuaaaucacaaauacaauuaaauguccuugggacaaaacccagguuuuauauuacaaagaguauuuaguuaccuaaagaaacaacuauuuuauauacuuccaauaaaauaguauguuaaaaucaacaagcuuccuagaaauauccauuuacagcaaagcuauaaaaugccugaaagacuaaaaccuuucuacucuugagaaauguuaggaaaaaauagcaugcauagaaaaaaacagcaaaguaaaaagaaaauuaauuauuacaagucagacaaaaugaaguuucaccugacgaaggcguuuauuagaugucccugggcuacuuuuccguaaacugcaaaaugcuugcagaccuuucauccaauccuacacucacaaaaaacauaaacagaaacaaagcauuagaaagaagcagacauaaguuuaugcaauuaucaaauuaucuuuuuuauauuuauuauuugccauucauacccugcaaguccuacucucaaaauauacuacauuauaauuucuuucuguccuaccaaagugaaacaaaaaacaaaauuuuuaagucaaagggccuacuuaggaucuaaaguauuauggucauuugguucauucuaggccuggcagaugauguucuauucccagacacguucauuuuuugaucuaauuuauuuuucagaguuuccucagaaaacagccauaucuguacaaaauacaguuaaauacucugaaauauuacaacuggcuuucuuuuagauuauacugacuuauggaaauguaaugaaaugauuaguuucaacugaauucauagauuacuuaauggucaauuuuaaagggcaauuuucauuccucauaacacuucacuguacaugugucuguguguaugucuauguguauuaaaaagaaaaaaaugcuaaaaacuauuaacaaaaacuuugacauggaguuucucauuuauuaaaauacuaccacuuuagacaugcuuucauaauucuguacuaugguaguuuuguaugcaaguuaauaaggaaaauuaggcuaauacaaagauauuaauaguuuaggaaaaagugaucuuaccucugcuuguucuggaguuucuccugcaaaguaaaagauguaauguucuucacuaaagugcugaacuacuaucugaaaacaguuuggccuuggaacacaugcacacaacacaggaaaaaaaaagaagaaaaauuauuuagaaacuuauaaaauauuuacaccaacuuuuaaaagccacaaaguguaauuuaagauuguuauaauuuuuaauuuagagaaguugguauuucguucuaccaaauuaaaauaucauuuauaaauuucaacauuuaaaauaaagggcaaaacuaauauuaaacuucauuacaaagagaaaagugauaaaaacguuuaaguagaauuucuagaauuacacuuaauuaauaaacagacacugugcauucucugaaaaguaaaaagaaauguucuuacuugaaaaauguuaaugcuuaucucuaagcagacuagaguuugaauuguuugcauuauaguuuucuauuuucaaguauuuuacagucuuguuuuuuuuuaaucuauuaaaucagaaacaccaucucugcuauaccgcuugcucuguaguuuaaugacuacagugucuguuuauaucuuccuccaguaugaaauaaacuugaaauugcuuaauaaaauguuuaacaaggaaguguucagaacucgguaagcauuucuuuguacuguagacaaagauuuuuaucaugcuuuggggagauacuaaaauaauggaaaauuaugaacugagaauuucuaauuuaaauauauaguaaucuaauugaaguauaaugugauuacaacuaucuaucuagacugggaaaauguacaguaauaacaaacaaaugugaagauaugaagaacagcauacauugcgaaauuugaaggauaagcucacuaugaaacgaaauugacauuccccauacaguuucuuuucaaaccuuuccaugugauaugugggaauggccaaaagcaaugaagcugaugugcuaagcagaaagcagcaagugaaaagcuauccaaaaauccccagauguuccaccaugauugggaaggaaaauggaacuuaggccccucaaugaacaaacuuuuguaucagacaccucaaaaugacuacauugucacauaagaaggcaaaaccaaagugaggcugaguuucccaacuucagaacucagucuuuacuuggucaccauagggcguaagaacaauaccuuccggaagcaguaacaucauucaaagcuuuucacacaaggugucugucauucaugcaaacauaagcagauauaagaaccagaaacaaaugaaaagugaaaaggaaaaggacagcagaggacaaauagccaaauacaguuuacaaguagguaaaacuuaaaucuuaaaacgaaugaacaaacaaaaccaguacggaugaagaacucgaucuacaaaaaaauuuaacuucucaacuuaaaaugugaucaauaaaaugaaucagagaacuuaacugaagauaaauagauuagcgaagugagccaucaaaaggacauaccuagguugaagaaaagauccuaagaguagauguaaaacacaaacaacccauacauuuaacuacaugggucaugacacaugcagauccuagaugaaauuuugcagaagcacugcaaaaauaugccaacaaguauuuuccuaaagcugagaaaagacaacagaucuuucauuuaagaaacuauaaucauuagaauuaaaaaaaauauauagcaauaggccuauucugguuuuguuaaaggaaaacccuucaaagcauccagaaaaggauuaauuagcacaaauaaauaaauaauauaucuaagagaaaaaaauugaagugucagugaaaaugauggaagacagcaaagcuauaauaugguuaaagaacucagagaugcuucuuaaugcagugugcuaugguuaaugaagacacauuauuguucagucugggaaugagcaacugacuccuugugucauagauggagcaucuguaugaguuucaugaaaaacagcuagaaaauauaagaaacagaaaauugcugaucuguuuuccuggucacucuccaaaaacagcacauacaauaaaaaguagacacuaaacuggccuauuucaggagcagagauuaaaauuugagcuucguuuuauagacauaacuuuucauaaaguuucagaccuggcaucauuaaauauucauaacuaagguaacauuuaaaguauauaaacaauuucuacaagcagcuguacacuagaagcaauaaaugaugauacagugaugcuaaaugucuauuuacugcuuuccaacugucagaacaugacaguuugguucuauaguuagaaauucacuccuuauucaauaaaugugacuuagaguuacccccacaaagagaguuuuuccuacagaacauauuuuuuaacucuuguaucaaacagucauagucugaucccuuuucuucauacaaaaacaaaaaacccgaggcuaaaacaccuuggauuucauuacagccuucauuuuuguuuuguuucuuuuuguuuucuaaaauaaaauuguuuuaucugaauucagaucuacagacaaaaccagccccauauugcuuauuuucaggaaauguuggguuuaauuucgccuuaauuggguaaagucucaggccuguccucaguccucucuagacacuggaaacacuucuccuucuccuuauaacugagaacaaagugacacacauguccauccugucuccuucaaugaaucuuucuugugauuuauaaaccaaacauucuguuuuccucugauuucuugagcucuaguaaagacacuuauacaugaauaguuuuuuagugaguauggagagagaaugacuugaaagggguuuuucugccaccuuguuccaaccuagccuuucauauugugaguauuuuaggugugcauuucuuauccuuaucagcauguuguuuuguuuuaaaauaaaaagaauagcaaagucaagugaauuuaugaaauauuuaguagcuaguucuacuacugagaagccauuccauccauaucuaccuaagaaucaaauugcacauacagcuuagacaaaagcugagaaaaaaacuuaccgguaaauaaguuuagguaauuuuaugcucuuaaaacaggucauauuugaaaauggucugaaaauaucuacuauuuuuauuauuaaaacaguuaagaaaagcacugucuuaccugccgaagagacugucauggacaacguagacagaacacacacuaaggucuauuagcccuuuugguuuuguagcucguuuuucacuuucaaaauaaauaaguugagcaucacugccuucuaagauaaaauauaaauuuuuccaacguuuuccuuuaccuguuaaaaaauaguaucuuuccuuaggaacuaugaaaucacauuuucagaauacaaaauuaaauacauuucaauuuucauuguaaguuuaaagaauagaucaaucccuguguaauuacaaaaugccucuaacauguagaaaaauacuuauuauugcuuguuuaauaaauuaauaaaugguagaguucauuagaauauuuuaacuuuaucuuuugauauuucauuauuauaauguuuaaaauucuuguuuuagagucaugguuuaccaccaauaucuaccucaauaacuuaauauaaaacugagguagauuuauaaauaaaaguuuaguacugugaaguccacgugccacaaggauuuucucuuaagaauccauaggugagagccugaaauuaagucaagauauaguggcacacuuuuaaaaauguaagcuuguucuaaaacccugguuauauguggauuuaauuaacuaaaccuaaauuucaaacauucuauguggaagcucugaacaaauacuuguuacuaauaacccaugacaaaacugaugucuugcaguaaguuuuauauauaauauuaaaauccuacauuaaauccuuagucuuaagaguuuccuuacccuucuucagaagauaaccuuuuuuaacaauauuuuuauaaaaagcauccuuugucuuccgacgaauuguguuauagaucuccuucccauccacagugucguucaguacuugcccuugauccugaguuauaaaaccauuaaaguuauuuaugaaauauaugcaauuacuaauuaaaaacaaggugaaaacaugucuaaaauacuaaaaccaaaauaugucuuccaaagaaaaucucagaaagguuuaucauuucuuaagaacaaugucucauggacaaaugccggguuuuuuuuuuuauuagauauuuucuucauuuacauuucaaaugcuauccccuuuccuaguuuccuauccaaaacuccccaaucuccucccccugcccugcuccugaacccaccuacuccagcuuccuggcccuggcauuccccuguauuggggcauauaaccuucacaagaccaaggggcucuccucccauugauggccaauuaggccaucuucugcuacauaugcagcuagagacacagcucugggggguagugguuaguucguauuguuguuccuccuauaggguugcagaucccuuuagcuccauggguacuuaaaugcuauuuuaaaccucauucagcuuguuguuaaauuuuauggcaaaugauacaguuuugaucuacuuauccaagaauuaacuugcaagucaggaggcaauguuugugaauguucuuuaacucugagaaacaccauguacaacuagaccacuccccacuugaaucaggacacacccccaucuuaacccucaguucaccacacacgauacagcagcgcaucauuacgucuucaccugcuauuucuaaacugucggauuuaaaauacuuuucuuccuacuacuuaauagcuuucuuuuguuccaccacuuugauagccacuuccgaaacaaaaaaacucacaucuuuuuucauuuuaaagcaccauauuauaacccuuacaaauauaaaguaaucaugaccuucacaaauaaacuaauauucaaauguauuaacauauacagaacuaaauuuugguauucccauuucuuuauaguaguucuuuuauuucugaaauauuacuauuuuauaguaucuagccuuuggggaggcuuugugugucuauucaacuucuugcaaauauagaauauuaaguuaucuucaugaucaccuuucuauuuuaagacauucugcuauuucauuuccuuauucagcagucaugcccaggcacuaaaauguuaagaaacggaagcauuacuuaccuccaauaaaggugacaaacugucuuacaugcuaaauucaacccauuaucucuuuuacuuuguugcugauuugaaguacuguaguuugaaccuagugcauucugcaauaugaggcaagugcuguacuacuuaguuauaucaucagguaccccacccccaaacccaguuuucuguuuuuguacaaaaaguuuuagugaaccacagaugauaauuaguaaugacuaauuuacuaguuuaauacaaacuuguaccauuguuuggugauugucuuuguauuagcuguagaauguggcacuccaauaauuuaagacauaccacauucuugacuucaagguaauuuuuacguguuacguguuucuauguauguaggugugucuagauguggaggccugaggacaaggccuuucccaaucauuuuccaccuuacuuugugagacacuguaucucccucaacagagauccugccaauucagcaagacugguaggcuagagagcucaagauccuucucucucuaccuuuaguuggugcugggauuauuguugcacucuacugcauacagguuuuuuuuuuaaguagacacuuggaaaucaaauuguucuuauguuuauaucauaagcacuguacuaacugaacucucuagcuuuauuaaauauuaaauuaagauauagugaccuacaaguuaauaaaugaugccaguaagaauaaagcuucacuuguagguuguaauaaaucacuaaaugauaacaaggcaugugucccucacucugacccacuuucuacauaguucugaacaagaaaaucucaacuuauacaguccuucuugaaacuaguggguaaacugagaaugcacaggcuguagccaaacuucaauucuauuacucgaugacuaggaaaacaucauuuaacacuucaagucaacaaucuacacucauuacagaucacuauguucuaauuagaggaagucaguaaauauaugaaguaaauuauacaguaaaagauguagacugcuuugcaaagaaguacuugucucuaagucucauaugaagcuuuuuuuuggggggggggguaaacuuuguauaacuaagaaaagguaaguagaugucugagggaaaaccuagcucauagauccaaaggaggcaaagagccuaacauguuuaacagucuucaacaggacaggcucuguuggcauaugcgauuaauuccaacuccccugcagaagcaggaggaucucugugagcucaaagccagccuguucuacagagcaagcuuccaggacagucaagguaacccugucucaacaaacaaaacaaaccccaaacagagcagaauucagggaacagacgacaugaagacagaaaaaaauagguauguggguaacacugaaauuccaguauaguuuucugucugccaccaaagguauuuuuuaucauuuauucugaaauauuaaacaucuugcauccaacucacauuuuaaaugucuaacucuuacaugcuauaaaggacaaaggcacacacaaagaaauaaaucauuuuuugugguguuuggguucugaacguauuuugaguucagagcaagaaggauauucccaacacaguaaauagggggaaaacaaccaaauaugacucagugacuugagaaauauacuuagccuuucuaguuuaaguuuuguuauuuguaaaauaggaugauuauaggauuaacuugacaaaauuguuggaauaauuaauuacuauauuauagaaaaauaccuaaaaugaaguauuuuuagaauuuugaauuuuuuaauguuuuucuuuauguugucuguuuaagagcaagaggcugcucacauaacacagcguacauguggaggucagaggauccuucuuccauugagugagugcugggacugaacucaguuagucaggcucaaagcacaguaccuuaccuccugagccaccucaucagcuguuuuuccucuagcgccuuuaacaugaaguacuaauucuaguacuggcuuguuucuauuuuagcugaugucuugguauuuaggguacauagaggggaggguuaacuugauugugcaagcugaucagguuguucauuagaaaaaaaauuguauuuucuaauggacugccaauuaugaaacagguguauauguuaugagucuucagccuucugcugaaaccuacauucauuccaagacuaacacaguauacuaucacuaacauuuaacugcuuauauauacauuuguuuuauaauaaccauuuuugaaacauucaaagaguaccaccuuaaaguuucuuugauuauuacaaggacuuacuaauuaucuacugacuuaacaaaauugaaaauuaaucaguucccuuacaauuaauuuucuaaaggaaaccaagcaaucaguaguuuuaaauuuuauguaguuuuagaagaaugcuuguacaaccaucacaaaaaaauuuugaaaacaagaugccaauuauugcaagcaaaauaauaauaauaaugcugaccugcauugguacagguuccuuaagauaauagccuucaacaaucuguucuuuccgauaauggucuaugauguccccgauacuguuaaaauaaaauaauuguguaaaucucuuagaauacaccuuguuaccaaggauuaucuauucagaaauuuuugaauacauauaaucugaauauauucauagaauuaacauaauagucacauuauuauagaaaaucugaauguuacaaauacagguucacagguuggaauacauaaguuaaagauucugguucacauauauaucaaacaugcaagcaaccaugaauggagcuccauacucagaaagugacauuccaugagaaaauaaggacaaucuggguuuguuuguuuuggggggguuaaaaaccaauccuucagacaugaaagugaagaacaaaaaugguguuuauuuagcaaauaauaaacuaagaauuuuuuacauuaaaucacuucacuuauauacuugauuuuguauaaaauuucauuaucacuaagauaaaaacaugaauauuuaaguagaaauagauguugaagaauaaaaaggaaaacuacccguuuugccaucugcacccgugagcugaggcuguuccacagccuguacacaggaccccacaggagagaccuauucuuucaggagcguuuucacuccuaggcucgguugugagauagccacugucagccaguagccagcagaacauaggaacaguggagcagccgggucacaauccuucaggauugccaugugcaccccugagccgaggcagauccacagccugcugugcacuggucuggccaggagaacccacuuucucuccaauaacuggcuggagcugggcagcaaggagaggagcacacgggugucaagaacaguggagcagcugggcacccagagcuugggcaguuccagagcccucuguacccgagcuccuccaggaaggagcugguuccuaggaguucgggcacaggcuuacagacccacaggagggacaagcuccagccagagacagcuagaacaucuaacaccagagauuaccagauggcaaaaggcaaacccaagauucuuuccaacagaaaccaagacaacuuggcaccaucaaaacccaguucucccaccacagcaaguucuagauuccacaacauaccagaaaagcaagauucggauuuaaaaucguaucucaugaugcugauagaggauuuuaggacagacauaaauaacucccuuaaagaaauacaggagaacgcagguaaacaguuagaagcccuuaaacaggaaacacaaaaaucccuuaaagaauuacaggaaaacacaaccaaacaggugaaggaauugaacaaaaccauccaggaucuaaaaauggaaggagaaacaauaaagaaaucacaaaggaagaccacucuggagauagaaaaucuaggaaagagauuagaaguaauaaaugcaagcaucaccaacagaauacaagaaauagaagagagaaucucaggcucagaagauacuauagaaaauacaacaaucaaagaaaaugcaaaaugcaaaaaaauucuagcucaaaaccagaaaauccaggacacaaugagaagaccacgccuaaggauaccagguauaaaagagcacgaagauucccaaccugaagggccaguaaauaucuucaacaaaauuauauuagaaaacuucccuaaccuacagaaagagaugcccaugaacauacaagaagccuacagaacaccaaauggaauggaaucagaaaagaaaguccucccaucacauaauagucaaaacaccaaaugcacaaaacaaagaaagaauauuaaaaggaguucaggaaaaaggucaaguaacauauaaagguagaccuaucagaauuacaccagacuucuugccaaaaacuaggaaagucagaagauccugggcagaucucauacagacccuaagagaacacaaaugccagcccagacuacuauacccaguaaaaugcucaauaaccauagaugaagaaaccaagauauuccaugacaaaaaccaauuuacacaauaucucucauauccagccugucaaggauaauaaaugaaaaacucaugguaugcacucacugauaauauuagcccuaaagcuuagaauacccaagauacaauucacaaacuagaugaaacucaagaagaaggauaaccaaaguguggauacuucgauccuucuuagauagggaacaaaauacccauagauagaguuacaaaguauggagcagacugaaggaauccagagacugccccaccuggggauccauuccauauaaaaucaacaaacacagacacuguuguggaugacaacaaguaccuucugacaggagccugagauagcugucuccugagaggcuccaccagugccugacaaauacagagguagaugcucacagccauccauuggacugagcacaggguccccaauaaaggagcuagagaaaggacccaaggagcugaagggguuugcagucccauaggaauaaccauaugaacuaacuaguacccccagagcuuccagggacuaaaccaccaaccaaccaaagaguacacauggaaggacccauggcuccagcagaguagcagaguauggccuugucagacaucagugggaggagaggcccuugguccugugcaggcucuaugccccaguguaggggaaugccagggccaggaagcagaagugggugggcuggucagcagggggaggagggaggggauagggugauuuugggggcgaaaccaggaaaggggauaacauuugaaauggaaauaaagaaaauaucuaauaaaagaaagaaaaagaaaaacuaagaguuaaucccccuguacaguugucucuauggcaugguggauuagaugacuuugauuaaaaaguaucaucaacuucuccauauauuuggaacauauuacagaugaaacugaaaguaaaaugacauaauauaacacaaaguuuaggagugccacuaaauauuuuuuguaauaaauaaaagugugaucuguuauuaauaggcuccauuaauuucuaauauuuaauuucuggaauuugaaauuuuuauuguguauacuaaauggaugaguauuuuuaaggcucccaaguaauagauuucuaacaagauuuuguuaaccugccccuugauuuauucuuuucauaguucuucaguggcagaauaacuguaauauuuuauguguauauguugugucuacaguuccaaguaucucuccuauauuacaaaauuaauuuaaauauaauagccacaaguaaaauauagaaauuguaaaagauaauuaaacgcauguacauauuaacagaugggaaggagaaauaaaaacagauaaaaucaauuuuuaagagaccauguuaaaaaaaaauugaaaauaggauaaaucuaaaacuauuuaaagaaaaacgaaaaucagaaaaaaaacugaaagcagccagauaccaccacaaagaugacuguguuguaaaguaaaauguaucauuuaucuaugaaaauuaauaaaggccaaagccuuuuguaugcaugaaaagguagacauaaucaugguaaaugcaggcauggaaauguaacagugaaacccaauaguuuuuauaauuaguauguuuuaaauauauaagugauccucagaaagauaauuuaaaauaaaaauuuaaaaagcuugaauggaaguacacuguguggguggauaaagcuauucuccaaagccacagauuauuagaagaaaaauacugugcuagaggugggcucauuuuuuaaagccuccaaaacaauguaagccagcacauuuauuauuauugaucaugagacauacaugguauucugaaaccaccacaccuguaacacugagaaauaaaguggaaacaaaguuauaagcuucuucucuccuguguggcucuaugaguucuagaaauugcuaugcaaguagcugggaagaacugucaccaaguuucaguugugugccugcugugcuacauucccaaccuacaggcaagauauguucagugggaugagacuauuauaguguuagccaacaauuuucugaaaggaccugaggacugguucauaggaggaaacucacaugugguacuauaaaccugaccaaguucaugacugcaccagucuuaggcucuagcaaggaagaagcuacagcugcuguuuugugaacugcacaugauguacaaccagauuuccuucucagcaagcguaguagcacacuccuuuaaaucagcacuuggcauguagagacaggugaauacugugagcucaaguaagguugagcaaggucuacacauuaccaggacagucugggcuacagaacgagacccugucuuagaaacaaaacaaauuugcuucuaaauaauguguucauucccagagauuagugcugcuaucacaucagcuuuggccaacgaagcuucuuucacagugcucuacaguuacugcugagacucacaacacaaauaaauaucuguugaaacugcagcuaaaacuugauaucucccaccccaaauucaagaaacacugugaaaggguuagaaugaauguaagagcugaaugaacggaugcaguguuguaggcugcugucuuccaguuauggcaugcguggccuuguauucauaaacucccaucaaguacuaccuguacaccaccguacaagauucaaucuuuaaacacccugccauggaaaagcgaagggcucccgaggagcaaucccucccugaggauauacagccaauuaauaguugcuacagaaaagaaagguauuuucuucaguuacuguagccgcuggggggaggggggccuaucuauaaaacaaauuucuaaagccaccaugccagguacuuuaauuuagugcauauuacauaaaacuaugcacaccucuuccuaagcccuacacagauguuacucuucaauguguuacuaaaaccucacugcuucccuuuuacuauuuaccgaaauuguagccuuuuggugguucucaagccuauuuguauuuuccuucaauucaucacaaagugaacaucuuuucuaacacuuuggaguacuaaauaauguagaaaugggucuuuuucuucuuucauguguacacagcacaguagauuucacuaaauaaucagucaauaaauaucugcugaauucaauuuggugcuaaaugccucuccuuuuccaaaguagcucaaauugcuucgcgaaacaaagcaaaaagucuaagaggaaaacagaauacuaaaguaugccuagcaagcuggauccuaggugaagaugucuaagccuagauuauaacauuaaaggaacucagguagcguaauacgaugagauacgcaaaugucuauaauuacaucuuucauuuaauuuuuuuuaacuguccacugaacuucugaugagcaaaagaucuuauccuugaauuucuguuuuccagauaaucagcuguugaggcuuaugaauuugaaacucaaacuagaacuuagggaauucuaauugagguggggaauauuaggucaguauuaaaaagcagguaaauacauuuuuaaaaauagaucauaccagcuuccaaaagaagaaauaacacggucaaagugagcaaauguuucacccuuucuccuuuccagaacaaugcugucacucuauauuacauaucacuguauuaauauaaucacuuuccuaagcaagcagugagacucacugugagccugaaacaaaguuuucuaggaguugagaagcagaaacaaaucagacauacaaaauguaucaacuugagacaauaauccaauaacauaauggcauuuguaaaaaaaaucagaugacuccuagagaauuacauacaaauagcuuguacauaaauacuugauuaaacaacaagacauuugggaguugaaaaguuauuaacaaucauguuugacacuguuuaaagcauucucauaaaagacuauuacaauuauaccagaaauugaggaaaucuguauauuuugauuccaacuauuuucaccacaagcugucgcuuaauuuaccuguuauaauagcggccucccaucauaaacugguuguuagguguuggacaaauuuuaaaucgcugaauauuuucauugguccgaaaauacagagaauaaucuccaggaguauuaucugagggccucacaagaaagcugcagacuuguccaacuguaaaaauuaagcuguuaguuuuauacucuaauuaucagagagaaaguauguuaaguaauuauuaaguucaaucacauguaaaauuuuauaauaaaacuuuuacuauuuucauuuuauguuucaaaccacccauguuauucucaguguaacacaagcauauggaacagaaauucuguacaauaacuucuggaguguaucuacacccuucgcucucugaaagaacucuccugacaguaacaggaacuaaaacuguugcaucaucuguuaaucuccuaaagaagauguugaaaguuaaacuaauuuugccuaauuuccccagauuuccaauuaauaauuuaauuuaauaauuuccaauuaauaauauaauauacuuauguaagaacuuacagaggcaaauaacuuaaguaccugaguauacuaucauaaguuaauacacacacaugauacuuuauucacuagguaugauccugagaaggcauacagaaaggacuaucuacaauugacaaggacuccuaagacuaucuuuccuuugugauggaguacugguaacagaaagaucaugagcugacucuuuuaagaaagcauaaccaacauaauuaucacauguaauucuuauacgaaucaguaauuguuucaaucaucuagcuggggcucuugcuaucaaguaacuugguacucaauacaaagaaguaaaaaauaauucuuuuuauauuggguuuucauggcucaacuuaauauauaaguaaauuuaaauugcaaacuaugugauuuaauguaggauuaaaaaaaaaaaccucuuggugaugauucugauacucucuguuucuucuacaaguuuguaaaugaguauguuugugaaauucugggggugacguuugcacucuuucaaaaagagaauaugaaugaacaaaaauagacucuaaugggagaaacuagguuuaggcuauuuucauguuuacacagcuaaaacaauacuggguacuucaaauacuuggcgauucgguaucuaaauauaaaccuacuccaacaacugacuaaaauaaguauuuaugguuccaccuugaaagcuaauggcauacuucugugguuuaaauuugauuucuauuucuaccauauagcauuguuguguuuuaaauuauauucuggaucuacuuaaugcugguuauuaaauccauuaaguacuucaaaaauuacuucaaaaccaaugagagcaaaucauugauuuaaaaauguaaugccuuauaucuuuaaacaacucagaucacauauuuaacaauuaguaguuuauuuacuauaauagccuauuuccagguacccuagaaaauagaugaacuaccaauuuuucaagaaccacaacaucuaaaauacauugauugauuuuugucccaaauguuugucaggcauuguuuacuaauaaauuaaccuagagaugagcaguuaauaauaaagacugaaguaacauagcugguaaucagugguucuuccuaaugcugugacccuuuaauauaguucccaugguguagugaccugcaaccaucaaauuauuuucgcugcuacuucauaacuaauuucacuauugaugugaauuuuaauguaaauauuuuuggagauaaagguuugucaaaggggucacaacucacagguugaaaaccccugcuuuaaauuauaaacccauaauauaaguaaauuuaauuuauucuucccugaacaaucauaguaauuagaaauuuaauaucaaauaagguucaauuauguaauuccaccaggcauacaagaauauauauugacacaugccuuuaauuuaacaguuggaagcagaggcaacuaaguagaucugugacuucaagaccaaccuggucuauaaagcgauuucaaugacagccaggacuauuacacagagaaaccuugucuaaacauuaaagaguauauuauguauucuucuaaguguguuauauguaggacagaccuaauauacauaaaaaaguauaucacaagauuguaagguauaaaauaggggaaaggaaacauggacaguggauagaaaagaagaaaaauauauuccaaaagagcuuacauguacauuucaaauuaaaacaaaaccagaaaauaccaacuccuauugcccagcauuggaaagaaauaacaguaugcauguauuaucaaaugcuagaaaaaaaaaaacuauaguacauuaaaaauggcuguuucaauuuuauacuuuauaaagauauuaaagaauacaaagguaccugucauuaauaaauuauaagcuucuuguuuggaaauuuucccguggaaccaucuuaaaaggagaacaaauuagauauuuaaaucaaaaguccacauggugcugcuuucauauacucaaagguaaccaagcugaugaaacaaaugucauggaaauggucaaauugucauuuguuacauuucuauugcguuuugcaaacuuauugugcuuuaucucaacaaaguauggacacacuaggaacugucaaguauaggcuacaauuaccguauuaauuacaauauuuuuaagagcaaugguuuuaguuuuaguaguaauugucacaugcuuauaacauagcuccauuuuucuuugaauggcuugggaaggauagagaaaauuauauaaggcaaaaauuauacaaggccuccaaauguuuucucaugcuucuuccuucaaaaauaauuuucuuuuaacauaagaucuugccuaguaaaauuaaaauguaaacaccagaacaaguacauacuaacagaacgaacuauguaggagaaugaaauuagaaagguaucuaauauuuuccuuuucauaaaauaacauguuaaaaaauuacuuaaggaucaggaaugguggugcauguauuuaaucccagaaccugggagacagaggaaggagaucacugugcucugaggucugcauagugagauccagggcagucaggacaagugagaucuugucucaaaaacuaaaauuuaaaagccaaaggucuauugauuuuuccucuuauuuacauuacaucucauuuucucuugcugguuaugucagaacacuucucuaccacuuugcuacaucuucuuaaugucuacagugauuuguaguaaugaguuaacggccagcuguaaaguacauauacuacaagacuaaaagccuaagugcucuaagaugcaauggcuuuaggcuuagaggucauucauucugcuucauauuauucuauuacuagggaaaguuaaaauacaacuuaauuuuuaaguaaaugaaaaaguaaucauuaacucagauuuccugauguucucaguauagauguaaauaaugaaaagcaaaugaacugcuuuaaaauguaugcacucaaguaaagauuaaauuaccauuuacuacagaguggauuuccauacuguagaagacuuagcuagauggcuuccaagacuaacucuacaguuuucuagcuuguaaaaauauaaacccaaagaauacaguuuaaaaaaagagacaaagaugaauaauauuuugagcacugagaaaauagccuugaggcacagggguaagauuauuucccacaguuauucuuauguaaaacuuauauauucaauuacauaacuuggacucaagguaacagguaaguccuugcucuuaagaaguccagacucugguuauaggaaaaacaaagggaacaacugaaaaccauguaaaauacagaaaguacagugauacagugauaggcaugugcuagggcauuuggagacuaacagagaaauguaccaagucgucagcauauguaaggaaaagcaugaacagucacucaacuuaaaguacucaaucccauaauuaaauacauaaacaacugcagguaaucccagacugggaaacagcuuaauaaucauuaaaaauaguuaugcauuuacaaggucuacaaagggaagagugaaaugaaaaggcaguaaguuacaagaagcaugugcaucacagaccaucauuuuaagaucugcugaagugaaguugguagggaaugaguucgggauuuuaguugagaaaguauaauuucugaugggaauuuuagacaagccauucuaagugcuggagcagagagugugagaugacugacaacuuggagggcccagaagaagaugacugcuguggcaggcacuaggaagagcgacuaucauaaaacuauuuaagacugaaaaguagggacucauucaauaaauauuuuaggagaaaaaauguacuagaacuuaauacccacacagauauggagcucaaaaacacaaaacaaaaacaaaaaacaaaacaauaaaaacugucaaaccagcuauugaaucucaaagggauucacugugacuaaggauacuuuagacaauuaugauauuucacugccauagucucuacuuuaaauacuuaaagagacuaggcagguacuuaaaauaaaccaauacaaauuuaacuuaugcuaaauuccacauaaauauaaaguucagaaaaacaaaagacuuacacguauuaauaugacuucccagugaagucuuauauuugacacugaaaaaugaaugcauuuuaaauauuuacuggcaucuuaaaucuguacuauuaaaacagauacaagggaaaaucugaaggauuucauaauacugaauucagauuaauuuagugugugugugugugugugugugugugcaagcacguguaugcaagcgagcaagcaaaagagagagugugugcauauguguuuuaaguauguggacaucaugauaugcacguggaagucagaggauaauuuguuggguccugcggaucaaauguaggugaucagaucuagcagcaaaugcuucuacaugcugagccauguuaccugcccaaugaauucacauucuaacacacauuaacuagacagagugguuaccuuaagacacacaaaaaacuuuauaguuuucuacuucucaaaaucuguauuauuaggcaaugaaugucaauuaccauuugcuaccacucagguaauugucuucugacaagagggaaagaaauuguucuuugcacuguggucucugucaaggguuuauauaauacagaacaguauuacuguguuuggaaaauauaaaauaugcauauauacacaaacacauaauauaaucugcuuuuguuaugaaucucaugcucuucaaggauuaacuagcauuugaaacugcugauagaacuagguacaguuagaauaauggagucacuuguaccugcauggaguauuauaacuauguacucauaauauauauucuauuaagacaggaaacuaagaaaacuacauauagaauacucagauuaauguaucuauuuucuaauggcuagauaacaggaaaauaaaacauuugaggcaaguuuuaaauuccaucuauaaaugcugagagcuugguuaggggaaaaaugcacuguaaaauuaacagguauauauucuauugaaauaauaugaccagaacaggauuaaaggcuuaagauuuuaaaaggaaucucauacacgcaaaaagauuauuuaaaaggacuuuacuuaguuauacuaaaauuuuuaguuaucucacauauuaaggauaaaaagugaauuuaaaaguucauuaaugauauggccacaaaaaauaagaaauacuguagucaguaagaaaaugaagagaaauaugagcccauuaugauucaaacauaauguuuaccagaaagucuuuuaguuuggugauaugagauuugaauauagguauaggccaauauuugcuuaaaauucuuacuaaaaaaaaauuuaguacuagcuccuuaagaaauauuuauauagccgggcgugguggcgcacgccuuuaauuucagcacaugggaugcagagacaggcggauuucugaguucaaggccagucugaucuacagagugaguuccaggacagccagggcuacacagagaaacccugucucgaaaaaccaaaaaaaaaaaaaaagaaagaaauuuauauaucaguuauuugaaucagauuuaaaaaaaaauguuaaucuaaaaaaagucauuaaguaugcugacuauuuucuaauuuaugauuuuuucuuuuaaaaaaauuaauaaaaacucacauuuugccuucguguggaucuucuucucggcccuaaaggaaagacauuaagacagaauuuuauaaaauuaaauccuaauauaauuucaugaaaauuccuaagaaucagaucuucaaaucuuucuccauaguaccuuucauaguuacauguauaggagaauguuucuauucuauaauuauuacugugcccuacuccaaccucucugaauucauuaguuuccauuguaaaugugcacuuaagaguaaaccaaucaaaugaaugcaaaauuuugaagccaaaccuuuaauuuggcucucuugccuacaaauuucucuuuuuacaagcaauccucuuaagcacaggucucaaaugcucgugugcauuuccugccucaucccacccauuuucuaucugucacaccuaacuacccauuugcuaaccaaccucacauuacuacucugguuugccuucuguuaugauugucacuaucaaaauguccuuucaacucauugcuaccuauucuuaaaaagcaaacuauuaagguaaacuaccucaaaugcuaucucuucacagugaaacauuuugacccuaaaaagugagaacuuucuuuucuguggauuauaacaugcauccuccuuuuuuuaaaaccguauuacaaacuuaaccuuaguauaguuuguacuccagaguguauuguugucuuguuuguuguuuuuguuuuguuuuauuuuugagacaucucccuauguaauccugccuauccuuauacauucauaguuuuuacuaaguauugguugaauucuaguccuaacaguuuauacagaguuuucaaugaacagauaaugaaagaaaaaaaaaaaguauacaaggacuucucuuaauuagggccucacuaaguauuuaaaaagacuaaaaucaaacauucaaugagugcauaauucaaauuaguguauaauaggcaaaaggaagucuaacauaaacaaaaucuaaaaauuuauaggaaaacuaacauauuuauaagaugcuugaaucugauuguuccugucuguauaccucuuccaauguagaauucggaaugcuauuuaaagaacuggaaguuauaauccuagaucuugcauuauguuugugacuaugaauacaggauauaucacauaauuuccauaacuccuuccaacuuuccucaguauguuuuaugcaugugaaucaagaucuaguugucagaauaagcagacaaaacaauuagcagcaaaacaaauuacucuaccaucuuccacacagggcauacauaguucugggguuccauaaaagaucacagaaagccauucuauucuaccacacaaaucuaagaggaaaauguaaauuccaaaauuauaauguuuaauacauuuuggugguguugaauauugucuguaaagcaugaacauugcuugagugcuaauuuguacuaauuugcuaaauauauugaugauuuaaauuauguacuaagauaaauaauaauguaugauagcaaagaaaacaaaggggaauauucaaacuguagaacuuugggguuauauaugaauaauacaauuaaaaauuucuaagauuauuagaauuauacacauauuugaaaaauuauaccaaacauacaacuauuuaaaauucugagucagauauaccuaaugaagaaaagaagcacaaaaaaauuaucgaaauaaguacaagugauagaaauauugaaguacuuugugcaaaggcagauauguauuauaacauacuaacauacuuuauuucuuuacaaauaaucauuuauuaacaccaaauacaccuuaaaauuucuuugcauuugaugaauuuaagcauuugacaagagaaaauuauuucugucuaaugacccagaaaacagacuucuaaacuuuuauaaagaacuugggaucuaaauguaaaugaguuaaauaccuaauaaaaaauggaaaaaaaaaaaaaaaaaaaaaagaacuugggaucugaaauuuagaagaacaaaugaaacuuaccaccucuuccacuaggucuucaacaauaaggccuugcucaucuguucuuagauugguaacccacauccauccaucuucuaacucauugugaacaaugaacauaucuccuuuuaaaaaacuacaauagcaaaugccauuacuaucuuaaaaaugaacauuuaaguaguccuaaaccauuagauauuauaucugaaauaugcaaaaacacuuaaaaaacaaaguucuaugcuguuucuagcaucuuuguuugugaaacugaagacaguaaaccugaauccuaauuucauuauauguacaauuuaauuauagguuuaguaauagagucugcuuugcuggauuauauucaaauuagaauuccucuaucuacuaccuacuugcuauauuagacucaaacuaaaauuccuuuaaauaguaaacaauuacuuauguauuauaaguaguuccaagaaaacugaauuuuaaaguuuccaaguuucaauguuguuuauuauauguaugacagauguaauaaaaagcaauauacacuuaagauauauauaaauauguauauauaaacauauauacauauuuauauauguguuugagaggauugauuuaauagaacuaagguuuauuaaguauugagcccauacuggaagaauauugaaaaauauaaaaacauauauauuuauauuuauauguaucuccuuuagaaagggaaacaaaguagcauuaauuagcaucuauaauuacaucuuaaauuuguuugauucagaugccuauuguuuaaagaguacagcacccagacaugguuaaaaggcaucuaugcuuuuuucccugcuauguaguucagagaggaugugcacuacuuaguuuccuuuuugcuaccuggauguuuucaggcucuacaccaucaaggaggcuucaguuggcuguaugucaauauaaaaucaccaagaauuccuugcaguuuuccuuccaggauuaaaugaaugacucuaaauauccuucugguuggaugcugccacugaccauacaccuauaagguaucuucauauauuuuucaauauucuuccaguauggucucaauacuuauaaaccuuaguucuauuaaaucaauccuucucucacacacauaaaugcuuucguuuuugccuaaaugacucuauuuuccucaaauuuaaaaaacaaagcuuauacaaaggagaacuuuuauaaaacacucuauauccaaaagccaaaaauuaaugccaucucaauucuaaaguccuccuuaauaauacccaagauuuuccuagauaaauggaagcugauuuuaucauuuaaccaaauacaucuuucuagaaccacuuucccugcuacuaagauaacaggaccauaccaucacaccuauauggaauuguuuuaucuucuuguuuacuacaagaaguucuagaugccuagucaaagaucagaacacaauguguuuugcuugcucauucagacaucaaaugaagcuauuuuuauuuagccagaauugaucacuuuaggguuguuacuuuaaaguaccugaaguuuuuaauacccaaaacguuagcacuauuauugugaagucacaaugaaaaauaauuccaaucucaugggcuuuggugauuaauuuuaugugucaaguuaacggaaugucaaccuauaugaagcauuacuucuggacuauucuacaugaaucaacauuugaauucauacauuaugcuaguguagcuuguuuuccuccauagaguaguuaucauccaguccacuaacugucugaacagaauaaaaguaagaugaauguuuccuuuccuuaucccccuuggccucacuguuuccucugagcugauucuuaucuucuguccucagagugggauguacucugacuuccauggucucuccaggcuuccguacuuaaaauuacagaaaugagucuccugaaucuguuccaauucuuaaaauaaaccuucucuggagaaaccaagauaacauauggacuaucuaagugagucucagaacaauuagaugaaauaaaguuagagacugcaaccuuggaugaucagaguugaaauuuacaaauuuucuaaaauuuacacuucaauacuacuaacuucuauuaaauaacuuucuuccuuuuuauuaauuguauucauuuucucacauuauuuuauaaauaaaugugugguaauaagaauuaaaugagaaggcauuagcuugacaauaauuauauaaaaaugaaacccuuauuugagauucaaacuauaucuuuguuuucuaauacuaauuucuaaaacuuuuaguccacaaaauauuuuuguauuauaauuugcaguuauuucaaagagaaacuauauaaucaguaauagccaaacauuuuauaguuaaaaaccaaggauucuauugaaugauuaaauagcuuuuuaaaaaaagagaauuugauuauaaguuuuauaaauaacuuaggagucaaauaacauacaaaaacuauaaugcuccaugauuacacaauauucuugaaaguuaagauuguuuacucauuauguaaaauuaagacaauuauuucagcaagauuuauagcugaggcauaaauguaauggggaauaaaaacaaacugauagauagauagauagauagacagacagacagacagauagaacauagguagauuagguagaguaggauugauagauauagauaauaaaagcacacaaauuaugagagaaaucucuacuuucucagaauuuuuuaaaaaaauaaucuaguuuuucucuuguaauuuucacuguagccacacugauacaaaccuugggaauagauaagccaucccaugggaaaauaacagaucgaguauuaaauacaacuuuauaugccuauaauauucucucaaauucaaaaucuuuccaaguuuaaaagcaaugaaucuucauugucuaccucuuuucaaaugcuacauaaaaaaacacuauaaaauaccuuauuucaucagugucugguacuuuuguguagggcagaauggcucguacacgccuucuaucuucuacuggcugaaaccaugaaaaguaaaaauaauuaggagcugguagaugcuucaugucuccauagcuaaaucuccagucucacaagcuugaaaauccaagcuggaucuacagagcccacauaaaaguuaugacagguauggcagcugccuguaaugccagcauuuaggaggaacgaacagggguaccugaggcaaacgaucaagccaaacuaaccaaauuuaaaagcucuaguuucauccagagacuuugcuucaaguaaucaaguagagagcaaucaagagugacauguugucaaauucuagccaccaguaauaaguuugcacgugcacuccuuccuugacacacaugcaagccuguauacacagucacagacauauacaaacacccaugcacacaaaagaagauuguuucuguaaaucaaaaaagauaaauucacacaaagcuugaagucaauauagcugcauacuauaaauuccauagucacuguaaucuuuacugagcaucuacauagaaccuagacauguuucugcucuuccuugauauuuuuagaaaaauuacucuacacgcauaacacauuuucuucggguaaucuaaacaauccuuaaauaagcuacagagaacauagaaauuaaucuaccuuuuaugauauaaacauuuaccuucucuagcaauuauuauaagcuauaaacacaaaauuaucuuuaaaaguccaguuacuuaaauacaaauauuaguuuugaaggaaacuaucauuuuuuuuguucuagaauuauaacuagaauuaaaacaaauauuuauuaaauucuaauacauguaagaaauuugguaagauuacaauccaucgauuuuguaaacuaaaaguugugauauaucaugcgaguuuuacuuaccucugguggugcaacuggauagaguaauuuuucuccuuuaaguaaacaagaaacgugacuguaauaaccuauuaggucugagagugaagaaaaacgccuuccaccaauguaguaaucaccacacauagcaauaauccuauaguaaaugaaacaaaacaaacaaauaaauaaauaaaaacaaaaaacauaguuugcaaaggaucuuaaaagccagucuuuuauagucucuuuucugaauaugaucaauuucauacucuuuuccauuaauauaacauuucuauauuuuaaaaauacauauuuauaucaucagaaauugaguauuauuuuaaaauauuuaugaauuugauaugacauauuuacaagccucaauuauguaguugaaucaaauauuugaaaauuuacccucagauaucucucuuuacuuucuauuuuuaauacucaacaauuguauaagggcuucuuugacuacaaguagcuugcauaucuuuugaaauuuaugugaacuguaauaaaaauguuacauaaaaauuaugaucggauauuacugaugugaaauuauauaugugaacuuaucacaacaaugacaguacccuuaaaacuuauucuaaaauguaaagacacaagaacauuuuaucaguuaaaacuagcuacagaugauuuauguuuuauuuuucucccauauuuucauuucacaaaaaugaaaugcaguaguaucgguaaguauacuuauauauagauauaccuuugaaauuuuacauaccuguuuaucucacagaagugaaaauguaucuuaagaauuucaagauagugagacuuaaaaaaaaaacuaaggacaaccucaacguccauacaguauuuucuguuacucuacagucucaaucuauacaucuuucauuuuaguuuuuaccuuuucaaaauguaucuguaguaauauauuccuuaauuguacauauauuugaaaacugccauuguaaaaggcaauauuacuaccuuuuuuggggggguuauaaaauguaguuuuauuuuaugguacucugcugcugcauagggcauaacauuuucacaaggcuuuuuugggacuacagucaaugauuagccaacacccaacauagugguccaagucucuaaagaauaauugcugggcaaaccagauacccucucacaugugcacaaaucugcauggaaaaguacuaaaguuuagacuuggacuuguguacuuuauuucuccuuucuaguguauuaagacugggaagagaggccccuuggucuugcaaacuuuauaugccccaauacaggggaaugcaagggccaagaagugggaguggguggguagaggagcagggcagagggaggguauaaggaacuuucgggauagcauuugaaauguauauaaagaaaauaucuaauaaauaaauaaauagaaauacuaauccaaaaaaaaaaaaaaaaaaaaaaggacgugcauuuuaauuugcccaaagcaaugcuuguauucuggcagcaacaugcuacuucuaucacaaagcuaacaaaggcaggagguguaagugaauuuuuauugggaaggaauugucaacuuaaacuguagugaaugaagaaugcauaaagagacucccuguugucacagacagauguaaccuccagauuaugugaugcaggagacauuucaaucugugaucuccaagcccggaugcauuaagcgcuuucccauucaauauuacuaccuuuaaacaaaaaguuuaaacacgucaagaguauuuacucuaaaucacugauuaaagaauuuaauugaaaucaaguuuauuauaccaaagucauucacuuuuauaaaagugaauauauauauauguguguacauguauauauauauauauauguacauguauauauauauauauauauauauauauauauauauauauaucagaguaaauacuaagugccauauuaaauaccuuaaacuaggaacaaagacuuaccuaaaaugauugacaacauuugucugacuaaggaaugaaaguacaaaggaccccggccuccgaucacucucucuuauaagauagcuuccagauuucccugccugccugaggcguucuucugcuauaguucuaucaaguuuuccaugauaccaccuagggaaaaaacacaaguaauuaaaauuaaaauaccaucauaaaauuucugugcauauggaacaauuacagucuuauagaauucaggucugugagaacacaacacuccaaguuuuaaauacccacaugcaauuuaaacauuuguuuaguacgaacaauugaauuuuaacuccauuuuucaccuccucucaaauucccuaaaaucaauaauucauuaaguauuuaaguuuguuguacaaauacaaacuucuuaucucacugaugaauauuuauugcucuagguuuacuuauauuucuucaaaacggaaguguuuauuacauuaaauccuuuccuggaacauaagagcaagaugaguaauuagaaauaauuuacaacucuauauauugaaguccaccugacauaaaaaagauuuggaaccuuauaaaaauaacauuuuaucuuauuuuagucuuacuacccugacagaagaacagaguaacuauuuaaaagacugcuauucaaauuuccuguuccaacagagccgauuaucgcccugcguuuuaugacaacuuacuucaugaacauauacuuaagcucaacuguucuuacagagaaaacauggguuugugugugugugcguguguguguguguguguguguguguguguguguagaaauucaacugccuuauguaacugaucauguuacuucaaaaguuuucuauaacuuuuaaaauacuuuucaaaucaucuuacauacaucugucucuucuaaaauuacuuaauuugcuaauugauaaaucucauaaaacaaagacaguacaaacaauuuaaaggcuacugugaagucuuccucuuaggcaaaacaauguuuguuaguaucacaaauacuguuuaacacacacacuuucagugaaaagugcauuauccugauucugcuuaucaaaacacgacccuacuuugagauccuguaaaguguauauccauaaagucauuuaaacgucuacaacuagagacauuacguuccucuuuuaaaccguacuacuacauauggacaucagauuccuuuaucucauuaaaaaaaucucaaaaggaaaaccuuuaucucacaaagaacgguuuaaaagcagacaugguguuucauacacguaaccucaguauuugggagguagagagguaggaggaucaagauucuccuuggcuaauagcaaguucaaggucagcucagacaauauaaauucccucauuucaacaaagggaaauuaaaaagagcaguguuuugcuuaggauuuccaaaauaaaaaugaaaagcaaagguggaacucaugcccuuggccauguccaugccauacuugaccacuauuaugauaaguuacaucauuccuaacucuuccaucaauuuuauacacaaaacaguacuggaucuuccacucugagcaauuuaaaccaagaaaauugaaaacaauaauaaugaaaaccgccucaugcuucaccccaucccucucaagacuaugacucagucuccauccuccagacgugggccccacagcaucaagguccacaggcauggcuuaaccuuucuagaucuuuuucucucucugcugcauccucaacauuccuugucauuauuuacaccaauccaauucacacaccauuccccaucuccccaccacuuccaaguuaguacccuacagacagauuuuuaaauaacaguuauucgagguagggauguagcucagauguccaaagccauggguucaacucucaccaccacaagaaaaauucagaaaaugcaaucauuaaauauaaaaauauaaaaacagaaaugaaaaaauaaagaugaaaugggagcauagaaaaauccaaacauuuaaaaauaaguaaucaaauucauaaaauuaagagcuaaugagauuaagaggaaauugagcaaauuuuuaaaagcuagauuacuuugaaaauaugguuaauaaagaaaaucaaguaagaaaauuaaaaaaaccauaaauuauggaugguacauaaucuacuuacaugugguaguuugguaggauauugccaagucuugggcuuuuagauacuuaguuuccaguugguaacauuguuugggaagguuuaggaagugggaccguuuuggaccagguauauuauugguuuugagaguuuaacaccuccagccaugcccaguuucuucucacuaggugacacuuaaagguucaauaugugagaccucaguuuccugcuugugccaucgggccuuuguuccacuaucuuaccauaagccuucucuaaccauaagcccaaauaaacucgucgauaaacugucuugcucaugguguuuuaccacaagaauuaaaaaagaaacuaaaucauagggagucagaaaaagaaaggaggaaagagaacgaaagaaaaguaaaaucuggagaaaauacaaaauaauucccaaauccaagaaagagaauaacaacaauaacaaacaauuaaaguccauaaaugggaaauaagaaaaagagauggggcagauauaaaugcagaguugcccuuuucaagauauaucagaacaaaguugcuaaaaaugagauuaaaucauaaaagcaaguauggaggcauuaucuuaaagaaacaaugguuaaaaucuuugcuaacuuuccaauauuucguuauucacuuuacaucccacucauugucugccuaccagucaccuccuggcaacccccaccccacccccauccacucuuccucuaagaggggggggggaacaccuuugguauccuccaacccuggcacauuaagucucugcaggaauagguacauccucucccacuaaggccagacaaggcagucuagcuagaagaacauauuccacauacaggcaacagcuuuugggacagccccuccuccauuugauuaggacccacaugaagaccaagcugcacaucugcaacauaaguucagggagguuuagguccagcucaaguaugcucuuugguugguaguucaaacucugagagccccaaggaucuagguuaguugauucuguuguacuuccucuggaguuccuagccccuucagggcuugcaauccaauccccauucuuccauaaaaguccccaagcuccaucaacuauuuggcugugggugucagcuguugggagccucucagagaacuagauucgugugugugugugugugugugugugugugugugugugugugugugugcgcgcgcgcgcgcgcgcgcgugcacgcccaugcgcaugcuucccuuauucuuccugguauggaacuaccaauuuccuuuguuuucuuagauguaguuauccuccuuggguuggaguuuuccuucuaguauuuucuguagggcugaguuuauagauagagacuauuucaauuuggauuugucuugaaauaucuugcuuccuccaucuaucaugacugagaguuuugauggauauaguugucuacauucgcaucugagguuuuuuuuaaagguugcaagauauuguccaggcucuuuuagcuuuuaaaauuucuguugagaguuuggguauuauucugauaggucugaaacuguacugugcaaagaaucacuaaacaugaaaauuuaggaaaagcagaaucaaagcaagaaaguacuucaauaaauucaacacucuuaagagaauuacuauacuaauauccaugcuggauaacagcacacaccagaaaugcagaagauucuaaguuaugugucuaucuaaaaggucaaacauuaccaauuccuuccccuaaauaucacaguacacagugguuaaauguuacugcauaugauagauggcauacugacuugcuacauacaauucacuguauuuguucaaaacaguucuuucuaacaaaaaucuagguuuuauuuaaauacauuaauaccaaaauaaagcacuguucacagagguuaaaaacaagaaaaucaauucaacaguuagacauuuauuacucagaaugauuaaaggguaccaaucuaaugucaucuuugcuauuuugaacaaagccauuuacuucccucucuugucuacccauuuuuuuuuacuauuacgcuuguacauacaaaucauuuuguuuuuuacccgcacucuuaaaagaugcucaauucacauaaaccaaucuauguauuaaaaaguauuuauggcauggcagcuuuugaguguaacccuaccacccagcagaccgaggcagaagaauccauaaggaguaccagcccauccagggaaacauggcaagacaguauuguaaaagaaaaacaaaacaaaacaaucuuaaaacuucuucagaacacuuccaguuuccuguguggaauguaugaaaauccaaagucaagaaugcaucuuuuugacaaaucaugaacugaauacagugaaaaguccacaacucuccuauagccuuagaaccugagacacuggcaaauauggagaagaaaaaaaaaaaucacaacucaacugaacagacacucaaaagcaaaaacucucuugggaaccaauucuuggauagagaaauguuaacugugacugaugaaucucuggagacuccauguggacagaucuaagaguucaagucccuaagacucagucauaacguuuuuaucuccaaggauuccuacuaguucuaagucuuaugaaugugcuuauauaacuacugaugagagcuucugaacauauaccaaaaauuaacuagagauacuacacauaaugaaucucaucucuuuguggcagugcccccauacugcauggcuuaaccucacugcagccuugauuuugaaaaccaagguauauuuuaugaccagccugcuaucuugggauucaauacuaaugaauguuuaccuuugacaccacugacuccagacuuucugucaacaacugcaguaucuggggucuggagauauggcucagcuuuuuuuuuuuugggggggggguuguuuuucuagacaggguuucucuguauagccuuggcugaccuggaacucacuuuguagaccaggcuggccucgaacucagaauucugccugccucugccucccgaaugcuagguuuaaaggccacgcccagccacggcucagcucuuaagggcuguucuuucaaaggaccugaguucaauucucagcaccuacaauggaacaaacaguuccaggggauucaaacccuuuucuaaccuccauggacaacaggagcacacauggaacacauauacaugcuggcacuauauauauauauauauauauauauauauauaauuaaacaaacaaaaucaauugcaguauuuuuacuauacacguaaaaaaucuuuuuuucuuuuacagaaaccuaacucaguuggauuucaaaaaguaacagacuguugccuuuuuccuaacaucuucaucaugauugauugauugauugauugauugacugauuuugguuuuucgagacaggguuucucaguucaguccaggcuguccuggaacucacucuguagaccaggcuggccugggacucauaaaucugccugccucugccucccaagugcuaggauuaaaggcgugugccaccacugccuggccaucuuccucaugcuuaaaccagcaugucuuuguguuauaugaaauguucaaagaauaaauaacauuauuuuauaaaaagagaagucauacccugaauaaaaaaauagcacauauuuugaauguacuuuuauauuagagcuuuuaauuuuguggagauuucaauaugcuuauccuagggagugccacuauuagaaagugcggccuuguuggauuagauauucccuuauuggaggaagugugucacugaagguaggcuuugagacccuccuccuagcugcccauaaaacauucuucuccaccagccuucagaucaggauguagaauccucagguccuccagcacugugcacacuucccaccaugauaauaauggaccgaaccccugaaucuguaagccaaccucaauuaaaagcuguccuuuauaagaguugcccuggucauggugucucuucagagcaauggaaacccuaagacagaaguugguaccgggacuggaauauugcugugauaagccugaccaugcuuugguuuggaggaauguggucuuugggucucuggaaagcagaggaauguuuuaaguggggcuuaauaggccaccaguauaagaauauggaagacauuggugcugaggaugguuugaacugugcaaacuuggcccaagagguuucaguggagaagaauuucaguauguggcauagagacuguuuguuauauugugaugacaaauguggcuccuucaugcccuugucugaagagucgccuaaggcuaagguaaagagauuuauauuaauuguauugacaaaggaagucucaaaaagcccagcaaagacuuuguucucugguuuagucuuaugaagaacauuuugaucaagcuuagcaaacuuccaaaggaaaaguacaaaauauauggcucaaagaauaaaggggcaacaagaaggagaacggagcuggauccuuuguucaaagagauaaucagauuaagggaguggugaccucaaggcaagaucccaucacccuaaaccuauuuuuaugcuuuuuguaacugaauaaggaacuacauuccaaaaaugugauccaaaucuuaaggcuggaagacaggcuuuugauccagaucuugagaaauaguagccaugaaaaucuuagguccaggcauagugugguacaucuuuuugacugaagaagguagaggcaugcagaucuuuuagcucaaggucaguuuacagagcaaguuucaggacauccaagcuuaggcagugaaggagcugaaaacagaaagcuggugauaauguaauagaacaagggggaacauuccaggcccagcaagcagcagaacucagcagcuuuggccauguggcucuggcuuuggagucaggaggaggagacuacugggacaauugaugcugguuagcuggaacuaagaaauuagcggugaucaucgucaaugaggugaaauccaggaaguguuuucugagagcacaaagaagcuguauuccagggauagccaagguuguaccucaugcuacagcugaaccugguaauguguaaaaaucauucacacgguacugguuuugaaggcaugaaggggucauggagaacagcuaagucuuggcacugggagaggcuagugaaggccauugguaaagguacagccucaguugcaguuaacagcccaggacugaagaggucauacaaagaaauugagguuuggcaccaugagaggcuauuggugaagccaaguggcaguagaaaauucagugaaucagagaugccaguacaugggaugacuacaaagaagagcagcaaaaguggagugaagacaaccuuacccuggagugcuauagagagcagaugugacccaagcccuuuggaggauaccauaagaucaaguguugaucccagaccuuggaacaagaagcuguaauguugaagcugccuugaaguccccaaaauauucaagaugccagggccaugggacagcugcugaggaaagcugcuaacagggaguaguacaagucaacaaaaaugaaaggagacagagaucugaagagagcuauuacaucagacauggagaugcugaguuugugaguuugaccagcuggcuuuuggucuugcuuuuguucaguauuucuucacuguaacauuuuggaaugguaauauaaauccugugauguuagauguaugugaccugcuuucuuuuaugauaauggacuggaccucugaaccuguaaccuaaccccaauuaaaaguuguccuuuauaagaguugccuuggucauggugucucuucauaacaauggaaacgcuaagacaaauuuuuaaaauuacucuuugaagcuggggguauauaacccagugguagaauauuugccuaguauauaucaggucccagauucaauccuaguauugaauaaaagaaauuuuuuaaguuccuguuugagcuggguauugugguacacaucuuuaguuccaucacucaauaggcauaggcagacaaaucccugugaggucaaggccagacuugguccuaggauagccagggcuacacaguaagacccugucuuuaaaagaaaaaagaaaucuucuuugacuuguucaauucaauuuuauuuugaaaauuacugaaugacuucaagauuaaggaaauuacaaauuauuucuaaaauggcccaaauauacugccauuuugaaguacauuauuuaugugaauugauuucucagcacugaugaucacaauauggagccaaguuuuaacuccuuaccuaaagggaaacauaccauccucaauagugugcauguuucucuaccuuuaauaaaugguaaaacuauauuuuauguauauacauguacacgcacauauacauaccagugaauggcuuuaaaacaaacaauuuauuuuaaguaaauauuuuauucuacauauauuuaauguacucaaacauguggaaucacaugaaagauuugugaaggaagggaccuuaaggggaauagcuuaggaaauucuucaauaaaugacuacaauaaaaacuagagaaaaagcuccuucuacacauaguggggaaagggaagaaaauaaagccaaagccugccugccuucuaacaaagccugccuucaagauaauuuaauuuacaaccuaaccuucgguaggugaaaaacacaauuucgacuaccuucaacuuccccauaaacucugacuccuuauagcuacucugucccaauuaaaacagagauggcagcagauaacuaaaaaacacugguaagaacauaggaucaauacucagacucacucauaagacacagacuacuucugucaauucauuacuaauagccuauuuuuaaaugguccuuuuauccaauaugucacauccacuauuugcacacuaaaagauacaaaauacagucugaaaagacaguucaaguaucaaaaucaggcacagcaggguuucuaaaaucuccagcuggaaacguuuucaaaacuaugacuaaacuaauuuucugagcagucuaacaaaagugguagaaaaccuucaaauguauagauaaguaagaaaggacauagaaauucuucuaagaaaacauuuaaaaagcucuagauaccaaaacaagggcaggggagaugacucaucaauuaagagcacuugcugcucagguuccauucccagcauccacauggaagcucacaaccaucuguaacucuaguuucaggggaucugaugcccucugaccuaagagccuuggauauacauggugaaagaagauacauaucagaaaaacagcauaaaaaaauaccuauuuuuaauuaauucuuaucagcauccaaaaaacugauaauucuuuagcuaaguuaaaaauuaaugagaaauuaaagaacauauauuauagacuccauaaggauaauaaauuaugguaauaugcuacucacaaauuugaaaaguuagaugaagcauacucauccuuugaauauauaaucuuccuauacucacaugagaaaaagauaaucuucguguauuuaaaacaauuaaauaaauaauauuucaauacugaauacaccaggcccauauauuguucauuaguaaauguuagcuaacauuuaugaaaaauaauuauuuauacaacaauuuauguguuaaaaaauaccagugugucuaaugucuuguuucuuuuaagacacucuaaagauaaaaagaacacagaacuuagagaucuaaaacuacaugaaauaugauaaguaaacauugucaguguuuauuauuucuauaugcauggaguggaagguaagucccuuugcuagccacacuguuuagaagcacacuguaaagaaaauaaguucucacauugaaaaaugagcauuaugguaaacuauucuauuacuauaaaucaagauuucauccuaagaacauuucuuuggaauaacuguuauguaguauuuuuuugauaauaauuguauuauauuuuuauaggcuacagccuacucacuaaagagagaagugaacaaaaagauauacauaaaaauuguggaaaaagaaugucauuguuuuauauauuuaucucuuaguuaacaguaggaacauuaguguaaggauauugugcauaauacauugccggcacuauaaaaucacuacaacaacaaaacuaguauacuauauacuaugauuuggaugagauucccucaaggguucuaaagguuugacauuagaggggcuauagacagaccucaggcuagcauacacaaggcccuauugcccagcacugaaaagggguaaaguggcagacccuuuuagaaaugaaaccugggggaaaauacuggguucacugcucacuggagucacuucaccugaacgggauuaauuugagucuuagcgguaguuaucuccugaguguacuuuucuaaaaguguggccaccauguuguuugacccauuuuacaaaaagccauuucucuccccuuggucugucguuuugugugauaagcuaccaggauuuccaauaccagcauacagauagaacaguccaauccugaacuuucacucucuaaaaccacuaccuaaguauauuuaaaauuuaucuuuuguuuaaaaaguauccaucucccaaauacucugugacagcaacagaaaacaaauuaaaacacuauacaauguagcaauugaguuuugcuguguuuuccccuaguuaaaugaaaaugacucuacacaacaacaacaaaaaguacacaugacucuggcugauuuacugucacuuggaagcaaccaagauuucuuucaguagcucaauaaaauuaaacuaaaauuaaacuaggguacauccagauaaugaaaacuagucacuguuaaaaagaaauauacuacccaguugugagaacauggaaaaauauuaaguucacauuaagagaagcaaucucaucuaaaaagcuaugggcuauauaauuagaucauuaugacacaaugaaaaagcaaaaccacggaaucaauacaaauaucagugccuaccagaagucauggaacaucucauacuauauccuaugcaaucaaguucuaauauauguaacccauuaacauaacagcagguguuauguuaaucaacaaccuaaauucaacuacaauguaagauacaaaccacaagaccacuuugaaaaagaaauaaaaaccugagaaaacuauucuagguuaaagagaaaguaaagaaaugugggaaguaaaugugacuuuuuuuuuuuuuuuuuguaauugguuuuugauagauacaggguuucucuauguaacccuggcuguccugggacuccauuuguugaccaggcuggccucaaauucauccaccugucuuugccuccagaauacucggauuaaaggcaaaugccaacaccacccugcugauauuaaaaacuuuuaauaccauuuuagaaacaauuaaaaaaucugaauauuauauuaauuuuaugauuauguuuaacuacuaagguuuucuuauucuuauuacauagugaaauaguugagauuuuuaagacaagaguuuaagauauaaucacuacaauuaguuuuggcauagauaauacauauaugcauaaugccaagguuauuauucaaguaugacauaaaguauauuauuaaguauuuuuaaaaguuuucagcaaauuuaaaaauuuuuaacauaaaauuuauaagggacgaacccaaagaagauaggaacuccacaagaagaccaaaagcagucaacuaaccuggacacuaaggggcuccuagagacugaaccaccaaccaaagagcauacaagggcuggacuuaggccccacugcacauauguagcagaugugcaacuuggucuuuauguggguccaccaacaacuagagcaggggcuuacccugacauuguugccugucuguggguuggcugacauugugccucccuuaacugugauucuugucugggcucaguaggagaagaugugccuaguccugcagaaacuuaagguggcaggguguguugguuccuggggagggaccuccuccuucucaggugaaggggauaagggugagaguacuggcaagagacccugugaaggggggaauggaaagacuggagggggagaacuugcaaucaagauguaaagugaauuaauuaauuaaugggaaaauauaugggggacuuugcuuaugcagucuucauaaaagcaugaguaacucguguacaaaaugaauacuaacaauaaaauagcugcaccaaaaggguuucauucuuagacugaagaagcacacugguuugaaugcaucacugaaugcaaccuaacucucgauaaaacugcaguuucuaagaguuauuaucuaaauuaguaccaucagacaggcugcugccaggucuuuuuuuuuaaccacaaaguuucuauaaugugucacaaaucaacuucacugacauauguaagguuaauuuucuaaaaauauauuuuauacuuauuguuuugaacaaaauuugguuugguuguuguuguuuuccaguuaaucauaguaccuuuaugcuguccuguuagucggaagaaugaagguuuaucccacaaucacuguagaaguuggguauuucagacaugagaagcagacaauggagagagauaaaacuccccaauuuguagaaaaagcaguagagcacgcaagaaacagcuuacuaaaggagagguuaaggugacacuguuuugcugaacacacaagccucaggguaaacaggaaaucaaaggaaaggacuauaaguaggaugcaacaccauuuguacaauuugucugcaucaaacgguucaaggauagucacaaaaggguuucaagaaggagucuaagacuguacaagaucauucuggaaauucauauaaaguuuuuuuaauauaaaguuuuuuuaauuuuacguaacugauuucugccaacauuuguuuuaaguagacaaaauuagaaugagacuagaacacaucacaaguaauaacuguaaaaggcguuccuuaaacuuuaggcuuucuuuuuagacuuauaucauguaguauuucagaaagccuuaauuuuuaccuagguugaaauaaaaauauugaucaagacccauguuaguugguugacgaaaaagauaggaucaaggagaaaauuugcauauuauuccaaaaggaauaaagaaaaguaguguuugaaacaaaaauaacugauuggauugauauagaaaagagagacacauaucuaacauauaaaacaaaaguaaaauuaucuugaaaacguaaaaggauuauagaucucccacauacccucaucacaauauguaaaccuuucuguggcauuccaaacagaguaagcaucuauauuauuguauuuuuuucuucuacugauuuucccacagguacauaagauacagaacauguccacaaaacuuaguacuaacugguccaaaagcuaacguugcuccucagugaucuaagauucugugaaauucugauacuaaacuaauccauguuuuuguugucacucaaacacaacugaucugaggaaauaaauaagcucacuauauacugaucugcuuuauacacaaaaagaaacaaacguguuagagugaaauaagguaucuaaaaauuucuauaagcugcugcucaauacauaauuagaccugucucaaaacaaugacauagaacaaaaagaaacaaauaauuauauccuaucuuaucaacaaaacuggcacuuaacaagauuaacaaagggaaagauaaaaauuaucaacacuaggaguaaaagaguaucauuauauaccaauuuuucagaagauaauuaacauagaugaaugcuaucaauagcuaaaaagcuaaguaauaauaaauaauaauaaauauuauguuaacaaaugauaaauauaagaaauaauaauaaauagcuaaauaauaaauaauauaugcuacccaugaaaauauaaggaccugaguucuagccacauuaaauaauaauuuuucuaagcugggcacauuggcacauauacuauaagcaggugcuugggggaagucagaaacaggcugacuccaggcucauuggcuggccagccacccuaagcuacuuguagagucccaagccagaaagagacacugucucaaaaaacaaaauaaacuguuccuaagaaaguauauaagauuguugucuggauuccacugcacacacacaaacacacacacacacaagccuauauucauccauucauauauacauacucacacacaggaauuagagaauuguauaauuauauauucauaaacuaaaccaaauagaauauaaaugcaucaaaaaucaugcaacaaaaauaagaugauaguuuacauucauauuaaauuccuaauuccaaacuuuuuuuaaaaauccagagccagauagugucacugaugaauuuuaccaaauaucuaaaaaucaaucaauagaaguacuucauaaacuuccaaaaaaugcaagaaagaaaaugucuucuccauauuaugagaucagaauuauucagucacuaaguguuacaagaaugcugccauuaucuucaaaauuuacauaacaaaucuaugugacuuauucuaagcauaaacucuuagacuuaacauuacaagcaccuucuauaaaaagccugacuuguccgaugcuagcaaagaaagugcuuguucuaaaagagaacccaucaagaagaggcaaagacaaccuacaggcugaaagaaaaucuuugugaagcauauacacaaaaagcaaguaacuaaaauuuugggaaaaaaauguuuauauauauauauauauugaaacuuaacaaaaaaaauucuaagccuaaaagagaauuuuuuuaaauggcaaucaagguggcucaguagguaaaggcaccugcuaccaaaccugacaaucugauuuugacaccuacgaccuacacagugaagagagaaccaacucccaccgguugucuucugaauuuuccuugugcaacaugggaccuaaauguacucacaccugaaaguaaaaauguaauuuaaaaauugaguuuuuguuuuaaguaacaguacuagaaauaaaaaaccacuagaaaugggacaaagauauuucacuagagagaauauauagguagcaaauaagcuccugaaaauauuuaacacuguuagucauuaggaaacaguuaauugaaacccuaaugaguuaucaugaacauuuaucacaaagucuaaaauuaacagagugauacuaaaugcugaugaagauagagagaaacaggaucauuuguguauugcuggugggauuaaaaaaacaauaaagcagaggcuaaagagauagauuagcaagagauaaagcaagaggcuaaagagauagguagcaagaagacuuuaguucagaucccauaaaucacaccaacagucaggcauggcugugagcaucuauaacccacugugcugugacuggcaaagagagaaggacugcugggacuugcugguggacagacuagcuccagguucagugggacucccuguagcaagggaauaaggcagagugugauacaauaggacacacaaagaagggauguagacaugcuagaaaacagagggcagcuucuuacagaaagcaaacaugcacuuaccacagaaugcagaaacuguauucauggacauuuauuuaauauaacaagaaauuuuggcuuacagcagcauuuuuucauaguagccuaaacuaaaaggaggcaaauguucaccagugacugaaugguuacauuguuacauuuguaccuuuuguaaauaccacaauacuaauuggcaaugaaaaaaaacaaaauauugguauauucaacagcauuguugaagcuggacagcauuuuccugagagacaaaugucaauguuaaacauacuaggguuccauuuauauagccuccuuuaaaugaaaaaaugaaaagcaguuaaguaguugccagagguuauggaaaaguaugagaaggagggaaagguuagucacacaagaacaucacaagcagccuggugaugacaaaacuauucucuacuucuaguguggugauaauuacauauaccuacgcauguaacaaaacugaacaggacuaaauauacauguacauagcuaaggaaacaugaguaaguggauuauguuaguuucuugguuugaugcuguacuuuaguuacauaaaauauuacuacugcagcacagucaaacccugcacacccuucuccucuguuugcagguucucccugaccccgcccauccaugcacccugcuagauuuggcucccagguccccauccagugccccaccuuagucuggccaccuaggccugcucagaaaccaaauucuaggcucccaccaagacugguccugccuacccaacucacaguccacucugaugcauauccaaccucuccaccaagccagaucuaccaccagucuaagauuagaccacaccagcccagccuccugucaaccuaacuucauucuacccaaacaauucaccaaccagacucaauccccacaagcauccucucuucugaccuaaccagcucuguccauaucaaacuuagaacuaauaaaggaacuucacgugguccagaucucaucuccaaauuaggaacaauaugaaaucucaagccaguaucgcucuccaaaaucuaccauuucuguagaaaugucaaucaaaugagaauuauccaagagacagaauuuuagaaaaaucacaagcuucauccaaaagaaaaaaaaaaaauucaagaagcuuaaagaagaaacucacacacacaaugaauuaauuaauuuaaaaaacagcccaccgaaauuaagaggaagaacuuaaggaaaaugaacacuugaguuaugcucaagaaaucacauggagauugauggggguaacaaagacaggauaggacuuagaaaagaacucaauaaagauauaaacuaugaagaaggcucaagcuaaaaugaagauggaacugaaaaacccaaaauccaacuagaaaacucagaggaagacuaccggaggcuuaaaagagucaaguacaaguagcauucuagauucucauaaucaagaauaaguacaaauaucauaaguugcaaauguaacuuuuauucuccuauaauaauuguugucucccugaucugcuaaccuagaccuaguccuggaagcuuccagccuccauacaaucuuauuuaggccuagaauauuucuagccucugagacuuaaugcugaauaaccucacccugucuuauucuuucugaacucuguugggcuaguucaacucugcuguucugguucaaacaccucuccaagcugacugaccuggcuucuuucuuagccacugaaugaauuacuuugcuuggccucauauuaacuguaguaauauguucuaaucuucugccuucuucucauuuccuggcucauucugucuucaccuaagucuaguuuacucucucuucaaccaaccucuguaaaacucuccuugaaaaacuggcuccuuucucucucugcauuauucccucaaguagcuucccuuuccuuucucuugagaagugggcauauucuauucugucaaaucuuucuuucucugauucaucacuuugucuuucaaggaugagugcuuccuucuacaacuaauuuuaccuucauuguuugggauuaaaguguauacuaaggacugagccaaaccacaauuagaaacagguuuauucagguaaguaacaaacaaacaaaacaaaacaaaacaaaaaacaaaaacaaaacaccucagaguuuacagcaugaucaaauauccugcaacauaaagugaaggucaguguuugaggacuuuuaaaaauguguuuugccuaaggucauacuuacucuucuaaacugucacugcagacgagugauacauauauauuguaaaagaaauaauuaauguacuauuaucaccuaaaaaguaaguguuugcuauuacauaaauaauacuauuuuauaagauuucucuggguaaacaccaaaagcacugcaaacucuggacugagacauuccuucaaaugaaguaguuuuauaauguuauaucauguguucuuuuuaagcuagcuuguauuucuaauaauucccauuugugaaguguaccaaucucucuuuuuuacucauucucuacacaaacacacacacacagacacagacacacacacacacacacacacacacacacacacacagccucucuguauguucucuauaaaacagugacccuccuuguuucauuugugcucugugauauaugugcucugaggccagugcccucaguagcccacucuggggaugcaggauaagcuggauccuucucaaaguuccaaccacaauaaauuacaucacauucauugcauauucuucauugaaaugaggauuaacuaacuuuggaauaacauuagaaaaaauaaaacucaaaauaccuacacguagaaugaaucaagcagaagacaaaauaucaggccagaaagauaaauaaaggaucuaaaccaaauacacaagaaauaggagauuaaaaaaaauaaauacauaaauauauaaaauaaaaauaaaaauaaauuuauaaaaggaaugaagcauacaggaaauauaagccaccaugaaaagaucaaacuucaaaacuacaggcacagauuuaugagaagaaucccaauuaguggcauaguucauaaccucgaaaagaucuuaaaaggaaacaaccccaaauuaaggggaaagcauacacauacuuauacaagagguacagagagcaccaaacagaacacacugucacucuaacaccauguaaagauacaacaauaucccauaugaacauaggcucaauaauauucaauacagauuauacaacaugagcaaguuggcuuuuaucccuuaguauagagaugguucaacauacauaagccaaaaaaaaaagaaaaaaaaauuuaaggcacauagauuuaaagacaaaaaaaaucacaugaucaaaucaacagcugcagaaugggccuuugaaaaacccaacacaucaugauaaaaauccuagagaauguagaacuagaaaaaacauaccucaguauaauaaaaagcucuacauggggaaccuacaggcaauauaauccuaaauugaaaaaagcuuuuaaaauucccacuaaaauuaaaaauaaaacaggauucccaccaucuccacuccuuuucaaaauuguguuugaaaugcuugcuggagcaacaaagcaacaaacagaaaauuaaagggauacaaauagggaaagaagucaaaguucuauuuauagauaauacuauacauuagagaguccagaaauucugucagaaaauuucuagaaacuaaaaauaaauuugcaauguggcaagauacagaaucaacugucaacagcuuuucuauaaaccaauaaaaaacacgcagaagggggccaagggcacgcacacuaccauucauaauagccuuaaagaaaauaaaauaucuaggaacaaccuaaccaaggaagugaucgacuucuacaaugaaacguugaaucucugaagaagcuagagauagacacaagaaaacaagacaacucaugcucguggauuaguagaauuaacauugucaaaauggccaucauaucaaaaagcuauuuacugaaccacugaagcugcuaaaagaaauaagcaguacucuucauaauaauaguguaggaaaugaauaggguuccauuaauccaagaauuaagaccaaaaauuaacaaauaggccaucaugaaacuucuguacaacuauauauacauauacauacauacauaaaaucaaucaacugggugaggaggaauccuacagaaugugagaaaaucuuugucaacuauucauaugauaguggguuuacgucaaaaauguauaaagaacucaaaaaaacaaaagucaaaacaaaugaccauucagaagugggccuaggaucugaacagagaauuuucaaaagaagaaaaaagaacaguuaggaaauaucuuuuaaaauguucaucauugguaagggaaacacaaaucaaaacaacuuugaaaguucaucauaucccaaucagaauggcaaagaucagcaaaaacaaaagauaacaaaaacuggagggaugugugggaaaaggaacugccauucacauuugaugggacugcauacuuguccagacacuggaagucucuguggauaauucucaaaaaucuaaaaauucaucugccauaccagcuaacuccuuggauuauucuuaaagaacacacaaagaacaugacacuucaaagauaacuuuguucauccauguucauuacugcuaacuguacaacagcuaggaaaucuaaucaacuuaaauuccugcaaccaacagggauaaugaaaauaugguacauaugcuauauaauacuauguagcuguaaaaaaauuaaauuaugaacguugcagauaaaugaauagaacuagaaaagauuauauugagugagguaucacagauccagaaauccaaaggucauauuguucuuucaguagaggcucuaaugagccaaauuuucagauaugacugcauauguauaucuggggguaacuguaaaaaccaauuaaguaaaagggaccacugccaagguagggagguggugaagcaauagagaggcagagcuggguacaagugauuagacuggggaacaagacaaaaggcagaccucugauuuagagaaggguuagggagauaaauacaggaggaggagagaaaagugcaaaauaacaguaacaauguugaaaaguuacaaagaaucauacuacuaucuaccuaaaaccagaaaaacccuauaaugcucauguauacucucaucugagcuggcaguauucccuccaagggcuaaagauuaucuaacaaaaacccaacagcaggcaugaaaagcccuccuuugaguuguuagucuaacuugucccagacuccuaaaacaucacaggcuacugcuauugauuaagucucuacuacugaagacacccugcccuuuacaugaaguauacagaaagcuuaaucuggaacugacuugaaauacuucucuugaguacuagcuuucaugguaguuccaaaagacacaaugcagcguccacagcuggaaagcaaccaacagaccuaccuauccaugagaccuaugaaccacaucaguaccgaguauggaacaacagcccuaaggcuacaguaguaguaugcauaccuuggaggcaacuaacagcucucuaauuggacuuaaggcccacucaacaugcaaucaugccuaguacuugaaaccaagccaacuauccagggcuagugaagucaugaaucuuggaagagaaucuacaaucaccacuuuacaacauaauccccaacaacauucuaaauaguuguucucaaaugggcaguaaguguaguucuuaucccucuucauggagaccucucuuugcaacacagaccauuacaaagaaccauaaucaaucuaaauguagagcuguggagccuagucccaaucuauaccucuauaaaccaucuccugaaccuaaggcucagggaacauugcugaagaggggaaaagcucuaaggucagaguuugcugugagacugugucuucuaggaauguuagaagcuacaccccauaaagucucaccaacauaacugccuaaaccugaacugaaaaauaacaagagcaggugugcuaaugucaaugagggaaagcccagcaggccucaaccuuacacagagaauacaggcaacuaaggaauguugagagggagaaaacaaaccuuccucaaggaacuagcauaccaacuguuuaucccauaccacgugaucaguccugcaagcauauauauacaacuaagauuauacaaaugagcaggucacauuuauguacuuagaaauauauauguauauagauauauauauuuauguaacaacaauuacuuuuaaaaaaaagccaugaaugugaaagagugcaacaggguuacauggcagggucuggagggaggaaaggguaugugaaaugaugugauuuuaucauaaucuccagaaacaaaacaguuacuuucaaaaagcacagaaccaaaaauaauaauaauaauaauaauaauaauaauaauacagagauuaaaaaggugauugcuaccacucagcuauuaaaaacaaugaauuuaugaaauucuugggcaaaugauguaucuggaggauaucauccugagugagguaacccaauaacaaaagaagucacuugauauacacucacugaaaaguggauaguagcccagaaaccuagaauauccaagauacaaugugcaaaacacaagaaaaucaagaaggaagaccaacauguggauacuucauuccaccuuagaauagggaacaaaauacccauggaaggaguuacagaggcaaaguuuggagcuaagacgaaaggauggaccauccagagacuaccccaccuggggauccaucccauaaucagccaccaaacgcagacacuauugcauaugccagcaagauuuugcugaaaggacccugauauagcugucucauaggaggcuaugccagugccuggcaaauacagaaguggaugcucacagucaccuauuggauggaacacagggcccccaaaggaggagcuagagaaagcacccaaggagcugaaggggucugcaacccuauagguggaacaacaauaugaacuaaccaguauccccggagcuugugucucuagcugcauaugaaucagaagauggccuagucggccaucacugggaagagaggaccccuuggucuugcaaacuuuauauggcccaguacaggggaacgccagggccaagaagugggaguggguggguaggggaguagggcagaggaaggguacaggggacuuucaggauagcauuugaaauguaaaugaagaaaauaucuaauaaaaaauugaaaaaaaaaaggugacugcuuuguuguuguuuugguuuuuuguuguuguuuugagacaagaucucaauauguagcucuggcuguccuagaacucacuguacagacuagacuggucucaagucagagacugccugccuaugccuccuaagugcugggauuauagacaugcaucaccaugccugccucagugaugcuuucuuagugucacguuaacguacaaucagucaccucacgagaaaugcuagcuuaaagagugaaagaucaauauuuugauaguacaggacauaggauaugauucuguuauaauaagguacuuagcagugagcucaguaguuacaccuacaaaaaaaauacaagcguuaagaggaaucuuucuaaguccuuauacucgguugaggcacauaaauuagauaaugaagauguuaaaaguuaagacugaggaugguaaaaugacucagccuguaaagacacccagcacucaaccugcugaccuaaguucaauccccagggcucacaugguaguaagaaagaagcagcuccuacaagcuguccucugaucuucauucgcgagcuaugguguguguacacccauaaaugcaaacauccacacaaaaauaggaaaacauuuaauuaaaaaauuuauacccccacacagauuaaaucgcauucucagacaucauccaaaaaauuccuuugcacaaugaacacaguuaaugcagaaaaucacaacugguccaaguauagagaauaugugucugugaagugcucagccauauaucaguuaucuguaucauaaaccucuccaugacucagagaacauccuagaacagaggauggaaagaggcagaggucaggggaagacuggggcaaaauguuaucgucugggcaugacaggacugcugacugaaucauaaacucaaaguagcuauggcugccugcaaacaaucaggagaggcaacauucugguagagugguacccaccucuagcaacuauugacagcugacaccuucugguaaagaaagggucagaucucguuaaggacguggucccugguaggucagccaugcucuaguggauggcaugacgccuaugcauauaugggcaucacaaauaaaaaucaauagacugaaaggaggcauaaaauugacaaagaauggagguggaucuagaaguaguuaagggaaggaguguaaggcaucaaacugcauuguaugcauaaaugaaauucuugaaagugaaaaauaauguaauaaaagauuaaauguuaaaacacaaaauacagaaaauuugcuguaguaauaucccacccauaggagcuacuauaaucaugugaagggucuucauauauuaacagucaugaacuuaaguuuauuuccaucuuuuaacacagacauaaucuacucccauacuaccaugaaugugccauaucuugucaaugcagacauagccaaaauagaaaugucauugacucacacaaaaaaaaaaaaaaaaaaaaaaaaggaggggggguaaaauaagacaaacuuuuacuuuccuacagugaaaacuggaauaaaaugauaauucuuuucucaaacaauguuuauuuaaucagcuccaaaaaucauccaaaccaauuuuaaaguguagaauuaaccaugguuuacuucagguugccauuaaaaaagaaagaaagaaaaagaaagcaacaacaaacaaaacuccagucucggugguauuguaugaccguucugcaaccuagaaauuaaaagaccaaggugcuagcaaaauuggcuucucucuuuacacaugguaaacuucucaguacccuaacauaaacuaucaucuguaugugcacacacccagcaucucuaccuaaaagccagcaguccugcuggaguuguaagccaugcuauuuaugcucuuauuuaauauaauuuaccacuuuacaggcucuaucugcaaauaagucacacugaggauuaauuagggccucaagaugaacauugguauucacuccagaauaccaaugacagguagcuagcuuugagguauuaucaauguuuaaaguguguguguguguguguguguguguguguguguguguguucucugucauacacugggacaaggaagagaagagaagagaagagaagagaagagaagagaagagaagagaagagaaagaaauguugaguaucccuaaucuaaaauaccaaauauuuaaauggauuuaaauucaggauauucacgugauauuuauaaaauucauauacacauuucagaauuugaaaaaaaugaaauuugaaauucuugccccaaauauuuaggauaagaaauaaucuguuuucuccaucacucaguuccaguuccaucacucaaguuuuccaaguacuacacauuaguguagcagcaacucucacuguagaguuauaaaaauuaaauaaaacaaucuguaagccacgcaagaugauagaaccuguaaucccagaaucaguagaugaaacaagcaaaggacuaauucaaagccugggaagcuaagcuacauaggaagaaaggaggaagucaugaaugacuguguguguguguguguguguguguguguguguguguguguguguguguguguguguguuuaugugugucuagcaaauauuacuaaauauaggguacuaagccuuugccuuguuaacccucaaaacaaaacaaagccaacagcuugauauucugacucaccauuaccuaguaaugugaauauaaauaaccuacucagagucuguuucuauaccugaaaacaggguucccucugacauaaugacugcuguauccugaauacaauuaucaacuaucaauagauaguugaaaaagaugaauacaaguauacaaaagauaaucaccaaacuuucgaaaaaaauuaaugaaauuaugguaagaaauuccgauaugcuucuuucacuuauuuucauuauuuuaauuugucaauaaauaauauacucugaauuugaaaagauuaccuauacauuuguauagacuaauuuuuaucuuauuucucugaacaauccuucaucuucauccaauuacauuucauauuuacacuuuuuccccugugauuuucauuuuuuaacucauuaaaaaauauacaaucaccaaaaugucucaaauacuucugaaauguguuaaaacaaggaggugauaauuaagcuguuauaauaacuuuuaagucacuccaaaaaaaaaaaaaaaaaccacacauguaauuucaagguucuacaccuauauaccaguaucuagacauucaaauaguguaccauaaguugcacugauacacaguaugcucuuaaaaacuauuaagacaacagaagcuaaaauguauauguaauauuauauguauauuauauaugugguaaggaauacauaacugaaaggcaauuuaccauguuauacuuauagaagccauuuguauuugcuuugucuccuacccuguaucucccaugagaaacaagcucagcacugacaacuauaagaccaaaauucugaucaaucacaaagaugcucuauauccuacaauaucaaauauucagccaagauuuaauucguuagaugacaauaaacaaauuuaucuuaauuugcaauuugcuuguuuuuuauaaauuauauauacaucaaagagccguugaaaauaaauuucccuuugacugaucaucaacgauuguuugacuaguauacuuauuuuagauauuuaacaucaugguaaaaauugagcaaaagggggucaagaauagaaaauauuucagaagcccuguucuaaagcagcauuugggcguggcaugugguacacaccuacaauccaaguacuccgagaaucucuaacccuggaccagccagcaccacauuguaagagcuuaucccaaacaaguaaauaaaaaaauaaguaaaacuguuauuuuagccaaugagguggacuucccuauaaucucagcuguucaggaacucaaacaggaugaucacuugagcccagaaauucaagcucagcuugggcaacaucucucaaccuugauuaaaaaaaaaaaaaaaaaagguaauuauaaaauaacuagcuaacaaggguauuuguauaccaaaagaauuacuaaacaguuuuaugaaaagaaaauuauauuuuuauggggggaggcuauuuauuggaagauaguaaauaaaugugcuuucgagcucaagguuuggagaaagaccuggcuucaaagaaauaaggagaaaaaugacagaaaagaacaccugacaguuuuauauacuacacacacccaggcaagagcauccauacauacuugagcacacaccacauacauguaccauacacacacacacacacacacacacacacacaaauagaagagaugauaauggaaucacuaacuagagcaccugaggcuccugaacacacacugagcuuccuggcaacucaguguggacugugauaugagaauaaaucuuauuuuaaaaaggaaaaaagaaguggauuugaauaauuaguaguaaauuuuaaaggcauacuagaaaauuugucuagguagcucaguggcagauauucugucuacuauguacaaagcccuggauuugauucacagcacuauaagaauuauguacacaugauccaacagguuauacucagaaauguguguguguuuaugcacauacauacacauauaaauauguauguauaaacaaauaaaaagaggcauuaaguaacaauuuuuaaaaagaggucauggauuuguagaagggcagagaggaauaugugagaggauuuaaaaggagaaaaggaaaagaaguaauuaaauuguaaccucaaaaauaacaaauauagauauauauauacacauauauacauaugacauuuuuaauaugaacacuuaguaaacuuuauauuuauuccuaaauauauuuuaaaauaaggaaaauacuaauagacuucucacaaacaaaauuuuucccaaauaaucaugcuuuuucuuuaaaacuuagucuaaaaaucuuauucaauuuuacucucaauguuaaauuccucuuuaaaagccuguuagaaacuagaaagugaaucugaugucucaagccuauucuaucccaguacuugagaugcugagcagcucaccacaaauucauggguagcuugggcugcucagagaacuguaggucaucucauacuagaacgagagccugucuuaaaaaacaaaaaaaugacuuuauuagaaauaauuuaacagcaauauccugggacuagaaagauggcucagcaguuaagagugcuugcuguuccuauagaaaagcaguguuugguucccaucacccacagaacugcucacaaccaccaguuacuccaggucuagggaacccgaugcccucuucuggccucugucacuagacgcuggcacagcacaaauacauacaugcaggcaaacacucauacccauaaaauaaaauuauuaaaacuucaaauggcuuuuuaaaaaacagacucuaaauaugccuaacucaauuacaaaaauggcacaauacuuuauucuuucagcauuaaauacuguauuuuauuauaauaaaaacauaauuguuuucaaaaguauguacagugugcugcaauuuuuuaagccuuucagaacauuucugacagacugaaauacacagauacaaauuagagaaaaauauugaaugaaaaguuauucuuuguaucaaauaacauuaaaagaaacaggacauccuuucaccauaccugguuguaucaaaauaaaccuaaguugaaauuuacaaaugcaucaaaaacaaagccuugugaccaaugcauuuucaaauuacauuaugauacaauacaauacccauacuaaucaaaaguguacucgcauuacaaaaugccucccugguuauuuuaaagucauuucuuaagccucuuaaagaagcuaacccucccaaagaaaacuucuaaaguguuuagaaagugucaauauaugaaacgaaucuuuuuucccuaauauucaccaaugcuauugaaauucuaagggucaauuaugauugauaugaaagaucuauaaaacauuucugaccuauuauuacuacuuuccaucucaacacuuucccuucaucaagaucaaccuacaguuauaaauacauacccauuucacuuaugaaaagaacacuuuuaaggagagaacucuaacuuuagagggagagccauuugcccugaucaugucacaaucaacuaccaaauuaauuuccacuaacaaaaugcuaaaaggaaaaauauuuaauauauuuagugucauggauauaauaaauauauaaaacauauuugcauauugcauauauuuauauguaaauaaauaaaucuaauaauucuaaggaacaaguuaguguucagucugggggcucuuaaucacgucuguaauucacagaacuuuuuuuuuucucuccacuucucuaaagagaucuaguguuuuuaugaaucgcaacgcuuccagcagacauuaaguaggaguuugcagcugcaguaaaaacaaaacauucugaccuaugaauuugcaacuuacauuaauauagucauuuaaauacuuguacucaacgccucugacuucagcagggagcacuggaguuacaauagacagcgguugccuuuauagugccaaguucugcugaaucccggacacuaucucaauuaggaaggggcagaaccauauccgguucccacugaauacaguuucccaugcuucccaucuuaaaaacuuuuacgucuucccaaaagagcaauaaacauacgaagacgccaggaagagugccuguaggggaaaaugacugaucaaauuaaaucccuauauauggaaccugaaacuucaaaacuugucaaacaaaucacagcggcaggagcacgguaugugucguugccccuucuuucccacuucuuacacggagccagcuuccacaaucccucaacagcaguuugacuuacugguuagugggaggugcggucagcgguauggccaccucuuccucuucguauucugguccauccagggagucaccuucauccacgguccccaaaccggagcccaaagggggcagcugaggaggcggcggcagaggagggaauccgccgcccggcccgagcgucucagcaggcaaagacagaguccccuuggugaaagcgacgucucccgcagguccggcggccgcagcaccagccacgccagcagcagcacugccggucagcgcggcgccccccaagacaccggccaccggcccgguccccaggaacccggaccccgacgcggcuccgccaccgagggccgcaaccaagucggcguccgccagcccgggacacggggcggcugccaccggcagggccgcggguaacuugacccggcacgcugccgaguaggcgcuggagcccguggccgcgccgccgccggggcccgccgucgcagggccgccuuccucacugcccgccucggccgccaucauguugaagcccgcucuccucuagcuacccugccgcccgggagccccgggggccagcaggcccgggcugcgagccgccccacccaggcgcgucccccuucagcucuccaggcagaggaaacaacaacaaaaggagagcgcccgccgccgcgcccccuccccgggccacagccccaagcuccgcggcugcuggcuggcuuacgggaagcgacgcgggcaaaaaacccagcgccugcagaaacgcuaggcaaaccucgccgcgcacacccacacucacgcgcacacaugcacaggggcgccaaacuuccuggcuacgcuaaagaggaagggaagcccgcugcagcggcugaggcagcgccgccucggccgccgccgccgccgcgccucaacgcccggguuccggccgcccccaccgcagccaccaguggggcugccuaugccagagccaccguagccucaucuccgccggcuggagucgggagcagugggcggggccgaggaagggggcgggcccgcagagcccgacuccgcugcgggcuaccugcggcucuccggagcgaaacccgggagagaaagaagggc

SEQ ID NO: 12504 - RNA, 74789 nt, Mus musculus
gcccuucuuucucucccggguuucgcuccggagagccgcagguagcccgcagcggagucgggcucugcgggcccgcccccuuccucggccccgcccacugcucccgacuccagccggcggagaugaggcuacgguggcucuggcauaggcagccccacugguggcugcggugggggcggccggaacccgggcguugaggcgcggcggcggcggcggccgaggcggcgcugccucagccgcugcagcgggcuucccuuccucuuuagcguagccaggaaguuuggcgccccugugcaugugugcgcgugagugugggugugcgcggcgagguuugccuagcguuucugcaggcgcuggguuuuuugcccgcgucgcuucccguaagccagccagcagccgcggagcuuggggcuguggcccggggagggggcgcggcggcgggcgcucuccuuuuguuguuguuuccucugccuggagagcugaagggggacgcgccuggguggggcggcucgcagcccgggccugcuggcccccggggcucccgggcggcaggguagcuagaggagagcgggcuucaacaugauggcggccgaggcgggcagugaggaaggcggcccugcgacggcgggccccggcggcggcgcggccacgggcuccagcgccuacucggcagcgugccgggucaaguuacccgcggcccugccgguggcagccgccccgugucccgggcuggcggacgccgacuugguugcggcccucgguggcggagccgcgucgggguccggguuccuggggaccgggccgguggccggugucuuggggggcgccgcgcugaccggcagugcugcugcuggcguggcuggugcugcggccgccggaccugcgggagacgucgcuuucaccaaggggacucugucuuugccugcugagacgcucgggccgggcggcggauucccuccucugccgccgccuccucagcugcccccuuugggcuccgguuuggggaccguggaugaaggugacucccuggauggaccagaauacgaagaggaagagguggccauaccgcugaccgcaccucccacuaaccaguaagucaaacugcuguugagggauuguggaagcuggcuccguguaagaagugggaaagaaggggcaacgacacauaccgugcuccugccgcugugauuuguuugacaaguuuugaaguuucagguuccauauauagggauuuaauuugaucagucauuuuccccuacaggcacucuuccuggcgucuucguauguuuauugcucuuuugggaagacguaaaaguuuuuaagaugggaagcaugggaaacuguauucagugggaaccggauaugguucugccccuuccuaauugagauaguguccgggauucagcagaacuuggcacuauaaaggcaaccgcugucuauuguaacuccagugcucccugcugaagucagaggcguugaguacaaguauuuaaaugacuauauuaauguaaguugcaaauucauaggucagaauguuuuguuuuuacugcagcugcaaacuccuacuuaaugucugcuggaagcguugcgauucauaaaaacacuagaucucuuuagagaaguggagagaaaaaaaaaaguucugugaauuacagacgugauuaagagcccccagacugaacacuaacuuguuccuuagaauuauuagauuuauuuauuuacauauaaauauaugcaauaugcaaauauguuuuauauauuuauuauauccaugacacuaaauauauuaaauauuuuuccuuuuagcauuuuguuaguggaaauuaauuugguaguugauugugacaugaucagggcaaauggcucucccucuaaaguuagaguucucuccuuaaaaguguucuuuucauaagugaaauggguauguauuuauaacuguagguugaucuugaugaagggaaaguguugagauggaaaguaguaauaauaggucagaaauguuuuauagaucuuucauaucaaucauaauugacccuuagaauuucaauagcauuggugaauauuagggaaaaaagauucguuucauauauugacacuuucuaaacacuuuagaaguuuucuuugggaggguuagcuucuuuaagaggcuuaagaaaugacuuuaaaauaaccagggaggcauuuuguaaugcgaguacacuuuugauuaguauggguauuguauuguaucauaauguaauuugaaaaugcauuggucacaaggcuuuguuuuugaugcauuuguaaauuucaacuuagguuuauuuugauacaaccagguauggugaaaggauguccuguuucuuuuaauguuauuugauacaaagaauaacuuuucauucaauauuuuucucuaauuuguaucuguguauuucagucugucagaaauguucugaaaggcuuaaaaaauugcagcacacuguacauacuuuugaaaacaauuauguuuuuauuauaauaaaauacaguauuuaaugcugaaagaauaaaguauugugccauuuuuguaauugaguuaggcauauuuagagucuguuuuuuaaaaagccauuugaaguuuuaauaauuuuauuuuauggguaugaguguuugccugcauguauguauuugugcugugccagcgucuagugacagaggccagaagagggcaucggguucccuagaccuggaguaacuggugguugugagcaguucugugggugaugggaaccaaacacugcuuuucuauaggaacagcaagcacucuuaacugcugagccaucuuucuagucccaggauauugcuguuaaauuauuucuaauaaagucauuuuuuuguuuuuuaagacaggcucucguucuaguaugagaugaccuacaguucucugagcagcccaagcuacccaugaauuuguggugagcugcucagcaucucaaguacugggauagaauaggcuugagacaucagauucacuuucuaguuucuaacaggcuuuuaaagaggaauuuaacauugagaguaaaauugaauaagauuuuuagacuaaguuuuaaagaaaaagcaugauuauuugggaaaaauuuuguuugugagaagucuauuaguauuuuccuuauuuuaaaauauauuuaggaauaaauauaaaguuuacuaaguguucauauuaaaaaugucauauguauauauguguauauauauaucuauauuuguuauuuuugagguuacaauuuaauuacuucuuuuccuuuucuccuuuuaaauccucucacauauuccucucugcccuucuacaaauccaugaccucuuuuuaaaaauuguuacuuaaugccucuuuuuauuuguuuauacauacauauuuauauguguauguaugugcauaaacacacacacauuucugaguauaaccuguuggaucauguguacauaauucuuauagugcugugaaucaaauccagggcuuuguacauaguagacagaauaucugccacugagcuaccuagacaaauuuucuaguaugccuuuaaaauuuacuacuaauuauucaaauccacuucuuuuuuccuuuuuaaaauaagauuuauucucauaucacaguccacacugaguugccaggaagcucaguguguguucaggagccucaggugcucuaguuagugauuccauuaucaucucuucuauuuguguguguguguguguguguguguguguguaugguacauguauguggugugugcucaaguauguauggaugcucuugccuggguguguguaguauauaaaacugucagguguucuuuucugucauuuuucuccuuauuucuuugaagccaggucuuucuccaaaccuugagcucgaaagcacauuuauuuacuaucuuccaauaaauagccuccccccauaaaaauauaauuuucuuuucauaaaacuguuuaguaauucuuuugguauacaaauacccuuguuagcuaguuauuuuauaauuaccuuuuuuuuuuuuuuuuuuaaucaagguugagagauguugcccaagcugagcuugaauuucugggcucaagugaucauccuguuugaguuccugaacagcugagauuauagggaaguccaccucauuggcuaaaauaacaguuuuacuuauuuuuuuauuuacuuguuugggauaagcucuuacaauguggugcuggcugguccaggguuagagauucucggaguacuuggauuguagguguguaccacaugccacgcccaaaugcugcuuuagaacagggcuucugaaauauuuucuauucuugacccccuuuugcucaauuuuuaccaugauguuaaauaucuaaaauaaguauacuagucaaacaaucguugaugaucagucaaagggaaauuuauuuucaacggcucuuugauguauauauaauuuauaaaaaacaagcaaauugcaaauuaagauaaauuuguuuauugucaucuaacgaauuaaaucuuggcugaauauuugauauuguaggauauagagcaucuuugugauugaucagaauuuuggucuuauaguugucagugcugagcuuguuucucaugggagauacaggguaggagacaaagcaaauacaaauggcuucuauaaguauaacaugguaaauugccuuucaguuauguauuccuuaccacauauauaauauacauauaauauuacauauacauuuuagcuucuguugucuuaauaguuuuuaagagcauacuguguaucagugcaacuuaugguacacuauuugaaugucuagauacugguauauagguguagaaccuugaaauuacaugugugguuuuuuuuuuuuuuuuuggagugacuuaaaaguuauuauaacagcuuaauuaucaccuccuuguuuuaacacauuucagaaguauuugagacauuuuggugauuguauauuuuuuaaugaguuaaaaaaugaaaaucacaggggaaaaaguguaaauaugaaauguaauuggaugaagaugaaggauuguucagagaaauaagauaaaaauuagucuauacaaauguauagguaaucuuuucaaauucagaguauauuauuuauugacaaauuaaaauaaugaaaauaagugaaagaagcauaucggaauuucuuaccauaauuucauuaauuuuuuucgaaaguuuggugauuaucuuuuguauacuuguauucaucuuuuucaacuaucuauugauaguugauaauuguauucaggauacagcagucauuaugucagagggaacccuguuuucagguauagaaacagacucugaguagguuauuuauauucacauuacuagguaauggugagucagaauaucaagcuguuggcuuuguuuuguuuugaggguuaacaaggcaaaggcuuaguacccuauauuuaguaauauuugcuagacacacauaaacacacacacacacacacacacacacacacacacacacacacacacacacacacacacagucauucaugacuuccuccuuucuuccuauguagcuuagcuucccaggcuuugaauuaguccuuugcuuguuucaucuacugauucugggauuacagguucuaucaucuugcguggcuuacagauuguuuuauuuaauuuuuauaacucuacagugagaguugcugcuacacuaauguguaguacuuggaaaacuugagugauggaacuggaacugagugauggagaaaacagauuauuucuuauccuaaauauuuggggcaagaauuucaaauuucauuuuuuucaaauucugaaauguguauaugaauuuuauaaauaucacgugaauauccugaauuuaaauccauuuaaauauuugguauuuuagauuagggauacucaacauuucuuucucuucucuucucuucucuucucuucucuucucuucucuucucuucucuuccuugucccaguguaugacagagaacacacacacacacacacacacacacacacacacacacacuuuaaacauugauaauaccucaaagcuagcuaccugucauugguauucuggagugaauaccaauguucaucuugaggcccuaauuaauccucagugugacuuauuugcagauagagccuguaaagugguaaauuauauuaaauaagagcauaaauagcauggcuuacaacuccagcaggacugcuggcuuuuagguagagaugcugggugugugcacauacagaugauaguuuauguuaggguacugagaaguuuaccauguguaaagagagaagccaauuuugcuagcaccuuggucuuuuaauuucuagguugcagaacggucauacaauaccaccgagacuggaguuuuguuuguuguugcuuucuuuuucuuucuuucuuuuuuaauggcaaccugaaguaaaccaugguuaauucuacacuuuaaaauugguuuggaugauuuuuggagcugauuaaauaaacauuguuugagaaaagaauuaucauuuuauuccaguuuucacuguaggaaaguaaaaguuugucuuauuuuacccccccuccuuuuuuuuuuuuuuuuuuuuuuuugugugagucaaugacauuucuauuuuggcuaugucugcauugacaagauauggcacauucaugguaguaugggaguagauuaugucuguguuaaaagauggaaauaaacuuaaguucaugacuguuaauauaugaagacccuucacaugauuauaguagcuccuaugggugggauauuacuacagcaaauuuucuguauuuuguguuuuaacauuuaaucuuuuauuacauuauuuuucacuuucaagaauuucauuuaugcauacaaugcaguuugaugccuuacacuccuucccuuaacuacuucuagauccaccuccauucuuugucaauuuuaugccuccuuucagucuauugauuuuuauuugugaugcccauauaugcauaggcgucaugccauccacuagagcauggcugaccuaccagggaccacguccuuaacgagaucugacccuuucuuuaccagaaggugucagcugucaauaguugcuagagguggguaccacucuaccagaauguugccucuccugauuguuugcaggcagccauagcuacuuugaguuuaugauucagucagcaguccugucaugcccagacgauaacauuuugccccagucuuccccugaccucugccucuuuccauccucuguucuaggauguucucugagucauggagagguuuaugauacagauaacugauauauggcugagcacuucacagacacauauucucuauacuuggaccaguugugauuuucugcauuaacuguguucauugugcaaaggaauuuuuuggaugaugucugagaaugcgauuuaaucuguguggggguauaaauuuuuuaauuaaauguuuuccuauuuuuguguggauguuugcauuuauggguguacacacaccauagcucgcgaaugaagaucagaggacagcuuguaggagcugcuucuuucuuacuaccaugugagcccuggggauugaacuuaggucagcagguugagugcugggugucuuuacaggcugagucauuuuaccauccucagucuuaacuuuuaacaucuucauuaucuaauuuaugugccucaaccgaguauaaggacuuagaaagauuccucuuaacgcuuguauuuuuuuuguagguguaacuacugagcucacugcuaaguaccuuauuauaacagaaucauauccuauguccuguacuaucaaaauauugaucuuucacucuuuaagcuagcauuucucgugaggugacugauuguacguuaacgugacacuaagaaagcaucacugaggcaggcauggugaugcaugucuauaaucccagcacuuaggaggcauaggcaggcagucucugacuugagaccagucuagucuguacagugaguucuaggacagccagagcuacauauugagaucuugucucaaaacaacaacaaaaaaccaaaacaacaacaaagcagucaccuuuuuuuuuucaauuuuuuauuagauauuuucuucauuuacauuucaaaugcuauccugaaaguccccuguacccuuccucugcccuacuccccuacccacccacucccacuucuuggcccuggcguuccccuguacugggccauauaaaguuugcaagaccaagggguccucucuucccagugauggccgacuaggccaucuucugauucauaugcagcuagagacacaagcuccggggauacugguuaguucauauuguuguuccaccuauaggguugcagaccccuucagcuccuugggugcuuucucuagcuccuccuuugggggcccuguguuccauccaauaggugacugugagcauccacuucuguauuugccaggcacuggcauagccuccuaugagacagcuauaucaggguccuuucagcaaaaucuugcuggcauaugcaauagugucugcguuugguggcugauuaugggauggauccccaggugggguagucucuggaugguccauccuuucgucuuagcuccaaacuuugccucuguaacuccuuccauggguauuuuguucccuauucuaagguggaaugaaguauccacauguuggucuuccuucuugauuuucuuguguuuugcacauuguaucuuggauauucuagguuucugggcuacuauccacuuuucagugaguguauaucaagugacuucuuuuguuauuggguuaccucacucaggaugauauccuccagauacaucauuugcccaagaauuucauaaauucauuguuuuuaauagcugagugguagcaaucaccuuuuuaaucucuguauuauuauuauuauuauuauuauuauuauuauuuuugguucugugcuuuuugaaaguaacuguuuuguuucuggagauuaugauaaaaucacaucauuucacauacccuuuccucccuccagacccugccauguaacccuguugcacucuuucacauucauggcuuuuuuuuaaaaguaauuguuguuacauaaauauauauaucuauauacauauauauuucuaaguacauaaaugugaccugcucauuuguauaaucuuaguuguauauauaugcuugcaggacugaucacgugguaugggauaaacaguugguaugcuaguuccuugaggaagguuuguuuucucccucucaacauuccuuaguugccuguauucucuguguaagguugaggccugcugggcuuucccucauugacauuagcacaccugcucuuguuauuuuucaguucagguuuaggcaguuauguuggugagacuuuaugggguguagcuucuaacauuccuagaagacacagucucacagcaaacucugaccuuagagcuuuuccccucuucagcaauguucccugagccuuagguucaggagaugguuuauagagguauagauugggacuaggcuccacagcucuacauuuagauugauuaugguucuuuguaauggucuguguugcaaagagaggucuccaugaagagggauaagaacuacacuuacugcccauuugagaacaacuauuuagaauguuguuggggauuauguuguaaaguggugauuguagauucucuuccaagauucaugacuucacuagcccuggauaguuggcuugguuucaaguacuaggcaugauugcauguugagugggccuuaaguccaauuagagagcuguuaguugccuccaagguaugcauacuacuacuguagccuuagggcuguuguuccauacucgguacugaugugguucauaggucucauggauagguaggucuguugguugcuuuccagcuguggacgcugcauugugucuuuuggaacuaccaugaaagcuaguacucaagagaaguauuucaagucaguuccagauuaagcuuucuguauacuucauguaaagggcagggugucuucaguaguagagacuuaaucaauagcaguagccugugauguuuuaggagucugggacaaguuagacuaacaacucaaaggagggcuuuucaugccugcuguuggguuuuuguuagauaaucuuuagcccuuggagggaauacugccagcucagaugagaguauacaugagcauuauaggguuuuucugguuuuagguagauaguaguaugauucuuuguaacuuuucaacauuguuacuguuauuuugcacuuuucucuccuccuccuguauuuaucucccuaacccuucucuaaaucagaggucugccuuuugucuuguuccccagucuaaucacuuguacccagcucugccucucuauugcuucaccaccucccuaccuuggcaguggucccuuuuacuuaauugguuuuuacaguuacccccagauauacauaugcagucauaucugaaaauuuggcucauuagagccucuacugaaagaacaauaugaccuuuggauuucuggaucugugauaccucacucaauauaaucuuuucuaguucuauucauuuaucugcaacguucauaauuuaauuuuuuuacagcuacauaguauuauauagcauauguaccauauuuucauuaucccuguugguugcaggaauuuaaguugauuagauuuccuagcuguuguacaguuagcaguaaugaacauggaugaacaaaguuaucuuugaagugucauguucuuuguguguucuuuaagaauaauccaaggaguuagcugguauggcagaugaauuuuuagauuuuugagaauuauccacagagacuuccagugucuggacaaguaugcagucccaucaaaugugaauggcaguuccuuuucccacacaucccuccaguuuuuguuaucuuuuguuuuugcugaucuuugccauucugauugggauaugaugaacuuucaaaguuguuuugauuuguguuucccuuaccaaugaugaacauuuuaaaagauauuuccuaacuguucuuuuuucuucuuuugaaaauucucuguucagauccuaggcccacuucugaauggucauuuguuuugacuuuuguuuuuuugaguucuuuauacauuuuugacguaaacccacuaucauaugaauaguugacaaagauuuucucacauucuguaggauuccuccucacccaguugauugauuuuauguauguauguauauguauauauaguuguacagaaguuucaugauggccuauuuguuaauuuuuggucuuaauucuuggauuaauggaacccuauucauuuccuacacuauuauuaugaagaguacugcuuauuucuuuuagcagcuucagugguucaguaaauagcuuuuugauaugauggccauuuugacaauguuaauucuacuaauccacgagcaugaguugucuuguuuucuugugucuaucucuagcuucuucagagauucaacguuucauuguagaagucgaucacuuccuugguuagguuguuccuagauauuuuauuuucuuuaaggcuauuaugaaugguagugugcgugcccuuggcccccuucugcguguuuuuuauugguuuauagaaaagcuguugacaguugauucuguaucuugccacauugcaaauuuauuuuuaguuucuagaaauuuucugacagaauuucuggacucucuaauguauaguauuaucuauaaauagaacuuugacuucuuucccuauuuguaucccuuuaauuuucuguuuguugcuuuguugcuccagcaagcauuucaaacacaauuuugaaaaggaguggagauggugggaauccuguuuuauuuuuaauuuuagugggaauuuuaaaagcuuuuuucaauuuaggauuauauugccuguagguuccccauguagagcuuuuuauuauacugagguauguuuuuucuaguucuacauucucuaggauuuuuaucaugauguguuggguuuuucaaaggcccauucugcagcuguugauuugaucaugugauuuuuuuugucuuuaaaucuaugugccuuaaauuuuuuuuucuuuuuuuuuuggcuuauguauguugaaccaucucuauacuaagggauaaaagccaacuugcucauguuguauaaucuguauugaauauuauugagccuauguucauaugggauauuguuguaucuuuacaugguguuagagugacaguguguucuguuuggugcucucuguaccucuuguauaaguauguguaugcuuuccccuuaauuugggguuguuuccuuuuaagaucuuuucgagguuaugaacuaugccacuaauugggauucuucucauaaaucugugccuguaguuuugaaguuugaucuuuucaugguggcuuauauuuccuguaugcuucauuccuuuuauaaauuuauuuuuauuuuuauuuuauauauuuauguauuuauuuuuuuuaaucuccuauuucuuguguauuugguuuagauccuuuauuuaucuuucuggccugauauuuugucuucugcuugauucauucuacguguagguauuuugaguuuuauuuuuucuaauguuauuccaaaguuaguuaauccucauuucaaugaagaauaugcaaugaaugugauguaauuuauugugguuggaacuuugagaaggauccagcuuauccugcauccccagagugggcuacugagggcacuggccucagagcacauauaucacagagcacaaaugaaacaaggagggucacuguuuuauagagaacauacagagaggcugugugugugugugugugugugugugugugugugugucugugucuguguguguguguuuguguagagaaugaguaaaaaagagagauugguacacuucacaaaugggaauuauuagaaauacaagcuagcuuaaaaagaacacaugauauaacauuauaaaacuacuucauuugaaggaaugucucaguccagaguuugcagugcuuuugguguuuacccagagaaaucuuauaaaauaguauuauuuauguaauagcaaacacuuacuuuuuaggugauaauaguacauuaauuauuucuuuuacaauauauauguaucacucgucugcagugacaguuuagaagaguaaguaugaccuuaggcaaaacacauuuuuaaaaguccucaaacacugaccuucacuuuauguugcaggauauuugaucaugcuguaaacucugagguguuuuguuuuuguuuuuuguuuuguuuuguuuuguuuguuuguuacuuaccugaauaaaccuguuucuaauugugguuuggcucaguccuuaguauacacuuuaaucccaaacaaugaagguaaaauuaguuguagaaggaagcacucauccuugaaagacaaagugaugaaucagagaaagaaagauuugacagaauagaauaugcccacuucucaagagaaaggaaagggaagcuacuugagggaauaaugcagagagagaaaggagccaguuuuucaaggagaguuuuacagagguugguugaagagagaguaaacuagacuuaggugaagacagaaugagccaggaaaugagaagaaggcagaagauuagaacauauuacuacaguuaauaugaggccaagcaaaguaauucauucaguggcuaagaaagaagccaggucagucagcuuggagagguguuugaaccagaacagcagaguugaacuagcccaacagaguucagaaagaauaagacagggugagguuauucagcauuaagucucagaggcuagaaauauucuaggccuaaauaagauuguauggaggcuggaagcuuccaggacuaggucuagguuagcagaucagggagacaacaauuauuauaggagaauaaaaguuacauuugcaacuuaugauauuuguacuuauucuugauuaugagaaucuagaaugcuacuuguacuugacucuuuuaagccuccgguagucuuccucugaguuuucuaguuggauuuuggguuuuucaguuccaucuucauuuuagcuugagccuucuucauaguuuauaucuuuauugaguucuuuucuaaguccuauccugucuuuguuacccccaucaaucuccaugugauuucuugagcauaacucaaguguucauuuuccuuaaguucuuccucuuaauuucggugggcuguuuuuuaaauuaauuaauucauugugugugugaguuucuucuuuaagcuucuugaauuuuuuuuuuuucuuuuggaugaagcuugugauuuuucuaaaauucugucucuuggauaauucucauuugauugacauuucuacagaaaugguagauuuuggagagcgauacuggcuugagauuucauauuguuccuaauuuggagaugagaucuggaccacgugaaguuccuuuauuaguucuaaguuugauauggacagagcugguuaggucagaagagaggaugcuuguggggauugagucugguuggugaauuguuuggguagaaugaaguuagguugacaggaggcugggcugguguggucuaaucuuagacuggugguagaucuggcuugguggagagguuggauaugcaucagaguggacugugaguuggguaggcaggaccagucuuggugggagccuagaauuugguuucugagcaggccuagguggccagacuaagguggggcacuggauggggaccugggagccaaaucuagcagggugcauggaugggcggggucagggagaaccugcaaacagaggagaagggugugcaggguuugacugugcugcaguaguaauauuuuauguaacuaaaguacagcaucaaaccaagaaacuaacauaauccacuuacucauguuuccuuagcuauguacauguauauuuaguccuguucaguuuuguuacaugcguagguauauguaauuaucaccacacuagaaguagagaauaguuuugucaucaccaggcugcuugugauguucuugugugacuaaccuuucccuccuucucauacuuuuccauaaccucuggcaacuacuuaacugcuuuucauuuuuucauuuaaaggaggcuauauaaauggaacccuaguauguuuaacauugacauuugucucucaggaaaaugcuguccagcuucaacaaugcuguugaauauaccaauauuuuguuuuuuuucauugccaauuaguauugugguauuuacaaaagguacaaauguaacaauguaaccauucagucacuggugaacauuugccuccuuuuaguuuaggcuacuaugaaaaaaugcugcuguaagccaaaauuucuuguuauauuaaauaaauguccaugaauacaguuucugcauucugugguaagugcauguuugcuuucuguaagaagcugcccucuguuuucuagcaugucuacaucccuucuuuguguguccuauuguaucacacucugccuuauucccuugcuacagggagucccacugaaccuggagcuagucuguccaccagcaagucccagcaguccuucucucuuugccagucacagcacaguggguuauagaugcucacagccaugccugacuguuggugugauuuaugggaucugaacuaaagucuucuugcuaccuaucucuuuagccucuugcuuuaucucuugcuaaucuaucucuuuagccucugcuuuauuguuuuuuuaaucccaccagcaauacacaaaugauccuguuucucucuaucuucaucagcauuuaguaucacucuguuaauuuuagacuuugugauaaauguucaugauaacucauuaggguuucaauuaacuguuuccuaaugacuaacaguguuaaauauuuucaggagcuuauuugcuaccuauauauucucucuagugaaauaucuuugucccauuucuagugguuuuuuauuucuaguacuguuacuuaaaacaaaaacucaauuuuuaaauuacauuuuuacuuucaggugugaguacauuuaggucccauguugcacaaggaaaauucagaagacaaccggugggaguugguucucucuucacuguguaggucguaggugucaaaaucagauugucagguuugguagcaggugccuuuaccuacugagccaccuugauugccauuuaaaaaaauucucuuuuaggcuuagaauuuuuuuuguuaaguuucaauauauauauauauauaaacauuuuuuucccaaaauuuuaguuacuugcuuuuuguguauaugcuucacaaagauuuucuuucagccuguagguugucuuugccucuucuugauggguucucuuuuagaacaagcacuuucuuugcuagcaucggacaagucaggcuuuuuauagaaggugcuuguaauguuaagucuaagaguuuaugcuuagaauaagucacauagauuuguuauguaaauuuugaagauaauggcagcauucuuguaacacuuagugacugaauaauucugaucucauaauauggagaagacauuuucuuucuugcauuuuuuggaaguuuaugaaguacuucuauugauugauuuuuagauauuugguaaaauucaucagugacacuaucuggcucuggauuuuuaaaaaaaguuuggaauuaggaauuuaauaugaauguaaacuaucaucuuauuuuuguugcaugauuuuugaugcauuuauauucuauuugguuuaguuuaugaauauauaauuauacaauucucuaauuccugugugugaguauguauauaugaauggaugaauauaggcuuguguguguguguguuugugugugugcaguggaauccagacaacaaucuuauauacuuucuuaggaacaguuuauuuuguuuuuugagacagugucucuuucuggcuugggacucuacaaguagcuuaggguggcuggccagccaaugagccuggagucagccuguuucugacuucccccaagcaccugcuuauaguauaugugccaaugugcccagcuuagaaaaauuauuauuuaauguggcuagaacucagguccuuauauuuucauggguagcauauauuauuuauuauuuagcuauuuauuauuauuucuuauauuuaucauuuguuaacauaauauuuauuauuauuuauuauuacuuagcuuuuuagcuauugauagcauucaucuauguuaauuaucuucugaaaaauugguauauaaugauacucuuuuacuccuaguguugauaauuuuuaucuuucccuuuguuaaucuuguuaagugccaguuuuguugauaagauaggauauaauuauuuguuucuuuuuguucuaugucauuguuuugagacaggucuaauuauguauugagcagcagcuuauagaaauuuuuagauaccuuauuucacucuaacacguuuguuucuuuuuguguauaaagcagaucaguauauagugagcuuauuuauuuccucagaucaguuguguuugagugacaacaaaaacauggauuaguuuaguaucagaauuucacagaaucuuagaucacugaggagcaacguuagcuuuuggaccaguuaguacuaaguuuuguggacauguucuguaucuuauguaccugugggaaaaucaguagaagaaaaaaauacaauaauauagaugcuuacucuguuuggaaugccacagaaagguuuacauauugugaugaggguaugugggagaucuauaauccuuuuacguuuucaagauaauuuuacuuuuguuuuauauguuagauaugugucucucuuuucuauaucaauccaaucaguuauuuuuguuucaaacacuacuuuucuuuauuccuuuuggaauaauaugcaaauuuucuccuugauccuaucuuuuucgucaaccaacuaacaugggucuugaucaauauuuuuauuucaaccuagguaaaaauuaaggcuuucugaaauacuacaugauauaagucuaaaaagaaagccuaaaguuuaaggaacgccuuuuacaguuauuacuugugauguguucuagucucauucuaauuuugucuacuuaaaacaaauguuggcagaaaucaguuacguaaaauuaaaaaaacuuuauauuaaaaaaacuuuauaugaauuuccagaaugaucuuguacagucuuagacuccuucuugaaacccuuuugugacuauccuugaaccguuugaugcagacaaauuguacaaaugguguugcauccuacuuauaguccuuuccuuugauuuccuguuuacccugaggcuuguguguucagcaaaacagugucaccuuaaccucuccuuuaguaagcuguuucuugcgugcucuacugcuuuuucuacaaauuggggaguuuuaucucucuccauugucugcuucucaugucugaaauacccaacuucuacagugauugugggauaaaccuucauucuuccgacuaacaggacagcauaaagguacuaugauuaacuggaaaacaacaacaaccaaaccaaauuuuguucaaaacaauaaguauaaaauauauuuuuagaaaauuaaccuuacauaugucagugaaguugauuugugacacauuauagaaacuuugugguuaaaaaaaaagaccuggcagcagccugucugaugguacuaauuuagauaauaacucuuagaaacugcaguuuuaucgagaguuagguugcauucagugaugcauucaaaccagugugcuucuucagucuaagaaugaaacccuuuuggugcagcuauuuuauuguuaguauucauuuuguacacgaguuacucaugcuuuuaugaagacugcauaagcaaagucccccauauauuuucccauuaauuaauuaauucacuuuacaucuugauugcaaguucucccccuccagucuuuccauuccccccuucacagggucucuugccaguacucucacccuuauccccuucaccugagaaggaggaggucccuccccaggaaccaacacacccugccaccuuaaguuucugcaggacuaggcacaucuucuccuacugagcccagacaagaaucacaguuaagggaggcacaaugucagccaacccacagacaggcaacaaugucaggguaagccccugcucuaguuguugguggacccacauaaagaccaaguugcacaucugcuacauaugugcaguggggccuaaguccagcccuuguaugcucuuugguuggugguucagucucuaggagccccuuaguguccagguuaguugacugcuuuuggucuucuuguggaguuccuaucuucuuuggguucgucccuuauaaauuuuauguuaaaaauuuuuaaauuugcugaaaacuuuuaaaaauacuuaauaauauacuuuaugucauacuugaauaauaaccuuggcauuaugcauauauguauuaucuaugccaaaacuaauuguagugauuauaucuuaaacucuugucuuaaaaaucucaacuauuucacuauguaauaagaauaagaaaaccuuaguaguuaaacauaaucauaaaauuaauauaauauucagauuuuuuaauuguuucuaaaaugguauuaaaaguuuuuaauaucagcagggugguguuggcauuugccuuuaauccgaguauucuggaggcaaagacagguggaugaauuugaggccagccuggucaacaaauggagucccaggacagccaggguuacauagagaaacccuguaucuaucaaaaaccaauuacaaaaaaaaaaaaaaaaagucacauuuacuucccacauuucuuuacuuucucuuuaaccuagaauaguuuucucagguuuuuauuucuuuuucaaaguggucuugugguuuguaucuuacauuguaguugaauuuagguuguugauuaacauaacaccugcuguuauguuaauggguuacauauauuagaacuugauugcauaggauauaguaugagauguuccaugacuucugguaggcacugauauuuguauugauuccgugguuuugcuuuuucauugugucauaaugaucuaauuauauagcccauagcuuuuuagaugagauugcuucucuuaaugugaacuuaauauuuuuccauguucucacaacuggguaguauauuucuuuuuaacagugacuaguuuucauuaucuggauguacccuaguuuaauuuuaguuuaauuuuauugagcuacugaaagaaaucuugguugcuuccaagugacaguaaaucagccagagucauguguacuuuuuguuguuguuguguagagucauuuucauuuaacuaggggaaaacacagcaaaacucaauugcuacauuguauaguguuuuaauuuguuuucuguugcugucacagaguauuugggagauggauacuuuuuaaacaaaagauaaauuuuaaauauacuuagguagugguuuuagagagugaaaguucaggauuggacuguucuaucuguaugcugguauuggaaauccugguagcuuaucacacaaaacgacagaccaaggggagagaaauggcuuuuuguaaaaugggucaaacaacaugguggccacacuuuuagaaaaguacacucaggagauaacuaccgcuaagacucaaauuaaucccguucaggugaagugacuccagugagcagugaacccaguauuuucccccagguuucauuucuaaaagggucugccacuuuaccccuuuucagugcugggcaauagggccuuguguaugcuagccugaggucugucuauagccccucuaaugucaaaccuuuagaacccuugagggaaucucauccaaaucauaguauauaguauacuaguuuuguuguuguagugauuuuauagugccggcaauguauuaugcacaauauccuuacacuaauguuccuacuguuaacuaagagauaaauauauaaaacaaugacauucuuuuuccacaauuuuuauguauaucuuuuuguucacuucucucuuuagugaguaggcuguagccuauaaaaauauaauacaauuauuaucaaaaaaauacuacauaacaguuauuccaaagaaauguucuuaggaugaaaucuugauuuauaguaauagaauaguuuaccauaaugcucauuuuucaaugugagaacuuauuuucuuuacagugugcuucuaaacaguguggcuagcaaagggacuuaccuuccacuccaugcauauagaaauaauaaacacugacaauguuuacuuaucauauuucauguaguuuuagaucucuaaguucuguguucuuuuuaucuuuagagugucuuaaaagaaacaagacauuagacacacugguauuuuuuaacacauaaauuguuguauaaauaauuauuuuucauaaauguuagcuaacauuuacuaaugaacaauauaugggccugguguauucaguauugaaauauuauuuauuuaauuguuuuaaauacacgaagauuaucuuuuucucaugugaguauaggaagauuauauauucaaaggaugaguaugcuucaucuaacuuuucaaauuugugaguagcauauuaccauaauuuauuauccuuauggagucuauaauauauguucuuuaauuucucauuaauuuuuaacuuagcuaaagaauuaucaguuuuuuggaugcugauaagaauuaauuaaaaauagguauuuuuuuaugcuguuuuucugauauguaucuucuuucaccauguauauccaaggcucuuaggucagagggcaucagauccccugaaacuagaguuacagaugguugugagcuuccauguggaugcugggaauggaaccugagcagcaagugcucuuaauugaugagucaucuccccugcccuuguuuugguaucuagagcuuuuuaaauguuuucuuagaagaauuucuauguccuuucuuacuuaucuauacauuugaagguuuucuaccacuuuuguuagacugcucagaaaauuaguuuagucauaguuuugaaaacguuuccagcuggagauuuuagaaacccugcugugccugauuuugauacuugaacugucuuuucagacuguauuuuguaucuuuuagugugcaaauaguggaugugacauauuggauaaaaggaccauuuaaaaauaggcuauuaguaaugaauugacagaaguagucugugucuuaugagugagucugaguauugauccuauguucuuaccaguguuuuuuaguuaucugcugccaucucuguuuuaauugggacagaguagcuauaaggagucagaguuuauggggaaguugaagguagucgaaauuguguuuuucaccuaccgaagguuagguuguaaauuaaauuaucuugaaggcaggcuuuguuagaaggcaggcaggcuuuggcuuuauuuucuucccuuuccccacuauguguagaaggagcuuuuucucuaguuuuuauuguagucauuuauugaagaauuuccuaagcuauuccccuuaaggucccuuccuucacaaaucuuucaugugauuccacauguuugaguacauuaaauauauguagaauaaaauauuuacuuaaaauaaauuguuuguuuuaaagccauucacugguauguauaugugcguguacauguauauacauaaaauauaguuuuaccauuuauuaaagguagagaaacaugcacacuauugaggaugguauguuucccuuuagguaaggaguuaaaacuuggcuccauauugugaucaucagugcugagaaaucaauucacauaaauaauguacuucaaaauggcaguauauuugggccauuuuagaaauaauuuguaauuuccuuaaucuugaagucauucaguaauuuucaaaauaaaauugaauugaacaagucaaagaagauuucuuuuuucuuuuaaagacagggucuuacuguguagcccuggcuauccuaggaccaagucuggccuugaccucacagggauuugucugccuaugccuauugagugauggaacuaaagauguguaccacaauacccagcucaaacaggaacuuaaaaaauuucuuuuauucaauacuaggauugaaucugggaccugauauauacuaggcaaauauucuaccacuggguuauauacccccagcuucaaagaguaauuuuaaaaauuugucuuagcguuuccauuguuaugaagagacaccaugaccaaggcaacucuuauaaaggacaacuuuuaauugggguuagguuacagguucagagguccaguccauuaucauaaaagaaagcaggucacauacaucuaacaucacaggauuuauauuaccauuccaaaauguuacagugaagaaauacugaacaaaagcaagaccaaaagccagcuggucaaacucacaaacucagcaucuccaugucugauguaauagcucucuucagaucucugucuccuuucauuuuuguugacuuguacuacucccuguuagcagcuuuccucagcagcugucccauggcccuggcaucuugaauauuuuggggacuucaaggcagcuucaacauuacagcuucuuguuccaaggucugggaucaacacuugaucuuaugguauccuccaaagggcuugggucacaucugcucucuauagcacuccaggguaagguugucuucacuccacuuuugcugcucuucuuuguagucaucccauguacuggcaucucugauucacugaauuuucuacugccacuuggcuucaccaauagccucucauggugccaaaccucaauuucuuuguaugaccucuucaguccugggcuguuaacugcaacugaggcuguaccuuuaccaauggccuucacuagccucucccagugccaagacuuagcuguucuccaugaccccuucaugccuucaaaaccaguaccgugugaaugauuuuuacacauuaccagguucagcuguagcaugagguacaaccuuggcuaucccuggaauacagcuucuuugugcucucagaaaacacuuccuggauuucaccucauugacgaugaucaccgcuaauuucuuaguuccagcuaaccagcaucaauugucccaguagucuccuccuccugacuccaaagccagagccacauggccaaagcugcugaguucugcugcuugcugggccuggaauguucccccuuguucuauuacauuaucaccagcuuucuguuuucagcuccuucacugccuaagcuuggauguccugaaacuugcucuguaaacugaccuugagcuaaaagaucugcaugccucuaccuucuucagucaaaaagauguaccacacuaugccuggaccuaagauuuucauggcuacuauuucucaagaucuggaucaaaagccugucuuccagccuuaagauuuggaucacauuuuuggaauguaguuccuuauucaguuacaaaaagcauaaaaauagguuuagggugaugggaucuugccuugaggucaccacucccuuaaucugauuaucucuuugaacaaaggauccagcuccguucuccuucuuguugccccuuuauucuuugagccauauauuuuguacuuuuccuuuggaaguuugcuaagcuugaucaaaauguucuucauaagacuaaaccagagaacaaagucuuugcugggcuuuuugagacuuccuuugucaauacaauuaauauaaaucucuuuaccuuagccuuaggcgacucuucagacaagggcaugaaggagccacauuugucaucacaauauaacaaacagucucuaugccacauacugaaauucuucuccacugaaaccucuugggccaaguuugcacaguucaaaccauccucagcaccaaugucuuccauauucuuauacugguggccuauuaagccccacuuaaaacauuccucugcuuuccagagacccaaagaccacauuccuccaaaccaaagcauggucaggcuuaucacagcaauauuccagucccgguaccaacuucugucuuaggguuuccauugcucugaagagacaccaugaccagggcaacucuuauaaaggacagcuuuuaauugagguuggcuuacagauucagggguucgguccauuauuaucauggugggaagugugcacagugcuggaggaccugaggauucuacauccugaucugaaggcugguggagaagaauguuuuaugggcagcuaggaggagggucucaaagccuaccuucagugacacacuuccuccaauaagggaauaucuaauccaacaaggccgcacuuucuaauaguggcacucccuaggauaagcauauugaaaucuccacaaaauuaaaagcucuaauauaaaaguacauucaaaauaugugcuauuuuuuuauucaggguaugacuucucuuuuuauaaaauaauguuauuuauucuuugaacauuucauauaacacaaagacaugcugguuuaagcaugaggaagauggccaggcagugguggcacacgccuuuaauccuagcacuugggaggcagaggcaggcagauuuaugagucccaggccagccuggucuacagagugaguuccaggacagccuggacugaacugagaaacccugucucgaaaaaccaaaaucagucaaucaaucaaucaaucaaucaaucaugaugaagauguuaggaaaaaggcaacagucuguuacuuuuugaaauccaacugaguuagguuucuguaaaagaaaaaaagauuuuuuacguguauaguaaaaauacugcaauugauuuuguuuguuuaauuauauauauauauauauauauauauauauauagugccagcauguauauguguuccaugugugcuccuguuguccauggagguuagaaaaggguuugaauccccuggaacuguuuguuccauuguaggugcugagaauugaacucagguccuuugaaagaacagcccuuaagagcugagccguggcugggcguggccuuuaaaccuagcauucgggaggcagaggcaggcagaauucugaguucgaggccagccuggucuacaaagugaguuccaggucagccaaggcuauacagagaaacccugucuagaaaaacaaccccccccccaaaaaaaaaaaagcugagccauaucuccagaccccagauacugcaguuguugacagaaagucuggagucaguggugucaaagguaaacauucauuaguauugaaucccaagauagcaggcuggucauaaaauauaccuugguuuucaaaaucaaggcugcagugagguuaagccaugcaguaugggggcacugccacaaagagaugagauucauuauguguaguaucucuaguuaauuuuugguauauguucagaagcucucaucaguaguuauauaagcacauucauaagacuuagaacuaguaggaauccuuggagauaaaaacguuaugacugagucuuagggacuugaacucuuagaucuguccacauggagucuccagagauucaucagucacaguuaacauuucucuauccaagaauugguucccaagagaguuuuugcuuuugagugucuguucaguugaguugugauuuuuuuuuuucuucuccauauuugccagugucucagguucuaaggcuauaggagaguuguggacuuuucacuguauucaguucaugauuugucaaaaagaugcauucuugacuuuggauuuucauacauuccacacaggaaacuggaaguguucugaagaaguuuuaagauuguuuuguuuuguuuuucuuuuacaauacugucuugccauguuucccuggaugggcugguacuccuuauggauucuucugccucggucugcugggugguaggguuacacucaaaagcugccaugccauaaauacuuuuuaauacauagauugguuuaugugaauugagcaucuuuuaagagugcggguaaaaaacaaaaugauuuguauguacaagcguaauaguaaaaaaaaauggguagacaagagagggaaguaaauggcuuuguucaaaauagcaaagaugacauuagauugguacccuuuaaucauucugaguaauaaaugucuaacuguugaauugauuuucuuguuuuuaaccucugugaacagugcuuuauuuugguauuaauguauuuaaauaaaaccuagauuuuuguuagaaagaacuguuuugaacaaauacagugaauuguauguagcaagucaguaugccaucuaucauaugcaguaacauuuaaccacuguguacugugauauuuaggggaaggaauugguaauguuugaccuuuuagauagacacauaacuuagaaucuucugcauuucuggugugugcuguuauccagcauggauauuaguauaguaauucucuuaagaguguugaauuuauugaaguacuuucuugcuuugauucugcuuuuccuaaauuuucauguuuagugauucuuugcacaguacaguuucagaccuaucagaauaauacccaaacucucaacagaaauuuuaaaagcuaaaagagccuggacaauaucuugcaaccuuuaaaaaaaaccucagaugcgaauguagacaacuauauccaucaaaacucucagucaugauagauggaggaagcaagauauuucaagacaaauccaaauugaaauagucucuaucuauaaacucagcccuacagaaaauacuagaaggaaaacuccaacccaaggaggauaacuacaucuaagaaaacaaaggaaauugguaguuccauaccaggaagaauaagggaagcaugcgcaugggcgugcacgcgcgcgcgcgcgcgcgcgcacacacacacacacacacacacacacacacacacacacacacacacgaaucuaguucucugagaggcucccaacagcugacacccacagccaaauaguugauggagcuuggggacuuuuauggaagaauggggauuggauugcaagcccugaaggggcuaggaacuccagaggaaguacaacagaaucaacuaaccuagauccuuggggcucucagaguuugaacuaccaaccaaagagcauacuugagcuggaccuaaaccucccugaacuuauguugcagaugugcagcuuggucuucauguggguccuaaucaaauggaggaggggcugucccaaaagcuguugccuguauguggaauauguucuucuagcuagacugccuugucuggccuuagugggagaggauguaccuauuccugcagagacuuaaugugccaggguuggaggauaccaaagguguuccccccccccucuuagaggaagaguggaugggggugggguggggguugccaggaggugacugguaggcagacaaugagugggauguaaagugaauaacgaaauauuggaaaguuagcaaagauuuuaaccauuguuucuuuaagauaaugccuccauacuugcuuuuaugauuuaaucucauuuuuagcaacuuuguucugauauaucuugaaaagggcaacucugcauuuauaucugccccaucucuuuuucuuauuucccauuuauggacuuuaauuguuuguuauuguuguuauucucuuucuuggauuugggaauuauuuuguauuuucuccagauuuuacuuuucuuucguucucuuuccuccuuucuuuuucugacucccuaugauuuaguuucuuuuuuaauucuugugguaaaacaccaugagcaagacaguuuaucgacgaguuuauuugggcuuaugguuagagaaggcuuaugguaagauaguggaacaaaggcccgauggcacaagcaggaaacugaggucucacauauugaaccuuuaagugucaccuagugagaagaaacugggcauggcuggagguguuaaacucucaaaaccaauaauauaccugguccaaaacggucccacuuccuaaaccuucccaaacaauguuaccaacuggaaacuaaguaucuaaaagcccaagacuuggcaauauccuaccaaacuaccacauguaaguagauuauguaccauccauaauuuaugguuuuuuuaauuuucuuacuugauuuucuuuauuaaccauauuuucaaaguaaucuagcuuuuaaaaauuugcucaauuuccucuuaaucucauuagcucuuaauuuuaugaauuugauuacuuauuuuuaaauguuuggauuuuucuaugcucccauuucaucuuuauuuuuucauuucuguuuuuauauuuuuauauuuaaugauugcauuuucugaauuuuucuugugguggugagaguugaacccauggcuuuggacaucugagcuacaucccuaccucgaauaacuguuauuuaaaaaucugucuguaggguacuaacuuggaagugguggggagauggggaauggugugugaauuggauugguguaaauaaugacaaggaauguugaggaugcagcagagagagaaaaagaucuagaaagguuaagccaugccuguggaccuugaugcuguggggcccacgucuggaggauggagacugagucauagucuugagagggauggggugaagcaugaggcgguuuucauuauuauuguuuucaauuuucuugguuuaaauugcucagaguggaagauccaguacuguuuuguguauaaaauugauggaagaguuaggaaugauguaacuuaucauaauaguggucaaguauggcauggacauggccaagggcaugaguuccaccuuugcuuuucauuuuuauuuuggaaauccuaagcaaaacacugcucuuuuuaauuucccuuuguugaaaugagggaauuuauauugucugagcugaccuugaacuugcuauuagccaaggagaaucuugauccuccuaccucucuaccucccaaauacugagguuacguguaugaaacaccaugucugcuuuuaaaccguucuuugugagauaaagguuuuccuuuugagauuuuuuuaaugagauaaaggaaucugauguccauauguaguaguacgguuuaaaagaggaacguaaugucucuaguuguagacguuuaaaugacuuuauggauauacacuuuacaggaucucaaaguagggucguguuuugauaagcagaaucaggauaaugcacuuuucacugaaaguguguguguuaaacaguauuugugauacuaacaaacauuguuuugccuaagaggaagacuucacaguagccuuuaaauuguuuguacugucuuuguuuuaugagauuuaucaauuagcaaauuaaguaauuuuagaagagacagauguauguaagaugauuugaaaaguauuuuaaaaguuauagaaaacuuuugaaguaacaugaucaguuacauaaggcaguugaauuucuacacacacacacacacacacacacacacacacacgcacacacacacaaacccauguuuucucuguaagaacaguugagcuuaaguauauguucaugaaguaaguugucauaaaacgcagggcgauaaucggcucuguuggaacaggaaauuugaauagcagucuuuuaaauaguuacucuguucuucugucaggguaguaagacuaaaauaagauaaaauguuauuuuuauaagguuccaaaucuuuuuuaugucagguggacuucaauauauagaguuguaaauuauuucuaauuacucaucuugcucuuauguuccaggaaaggauuuaauguaauaaacacuuccguuuugaagaaauauaaguaaaccuagagcaauaaauauucaucagugagauaagaaguuuguauuuguacaacaaacuuaaauacuuaaugaauuauugauuuuagggaauuugagaggaggugaaaaauggaguuaaaauucaauuguucguacuaaacaaauguuuaaauugcauguggguauuuaaaacuuggaguguuguguucucacagaccugaauucuauaagacuguaauuguuccauaugcacagaaauuuuaugaugguauuuuaauuuuaauuacuuguguuuuuucccuaggugguaucauggaaaacuugauagaacuauagcagaagaacgccucaggcaggcagggaaaucuggaagcuaucuuauaagagagagugaucggaggccgggguccuuuguacuuucauuccuuagucagacaaauguugucaaucauuuuagguaagucuuuguuccuaguuuaagguauuuaauauggcacuuaguauuuacucugauauauauauauauauauauauauauauauauauauauauacauguacauauauauauauauauacauguacacacauauauauauauucacuuuuauaaaagugaaugacuuugguauaauaaacuugauuucaauuaaauucuuuaaucagugauuuagaguaaauacucuugacguguuuaaacuuuuuguuuaaagguaguaauauugaaugggaaagcgcuuaaugcauccgggcuuggagaucacagauugaaaugucuccugcaucacauaaucuggagguuacaucugucugugacaacagggagucucuuuaugcauucuucauucacuacaguuuaaguugacaauuccuucccaauaaaaauucacuuacaccuccugccuuuguuagcuuugugauagaaguagcauguugcugccagaauacaagcauugcuuugggcaaauuaaaaugcacguccuuuuuuuuuuuuuuuuuuuuuuggauuaguauuucuauuuauuuauuuauuagauauuuucuuuauauacauuucaaaugcuaucccgaaaguuccuuauacccucccucugcccugcuccucuacccacccacucccacuucuuggcccuugcauuccccuguauuggggcauauaaaguuugcaagaccaaggggccucucuucccagucuuaauacacuagaaaggagaaauaaaguacacaaguccaagucuaaacuuuaguacuuuuccaugcagauuugugcacaugugagaggguaucugguuugcccagcaauuauucuuuagagacuuggaccacuauguuggguguuggcuaaucauugacuguagucccaaaaaagccuugugaaaauguuaugcccuaugcagcagcagaguaccauaaaauaaaacuacauuuuauaacccccccaaaaaagguaguaauauugccuuuuacaauggcaguuuucaaauauauguacaauuaaggaauauauuacuacagauacauuuugaaaagguaaaaacuaaaaugaaagauguauagauugagacuguagaguaacagaaaauacuguauggacguugagguuguccuuaguuuuuuuuuuaagucucacuaucuugaaauucuuaagauacauuuucacuucugugagauaaacagguauguaaaauuucaaagguauaucuauauauaaguauacuuaccgauacuacugcauuucauuuuugugaaaugaaaauaugggagaaaaauaaaacauaaaucaucuguagcuaguuuuaacugauaaaauguucuugugucuuuacauuuuagaauaaguuuuaaggguacugucauuguugugauaaguucacauauauaauuucacaucaguaauauccgaucauaauuuuuauguaacauuuuuauuacaguucacauaaauuucaaaagauaugcaagcuacuuguagucaaagaagcccuuauacaauuguugaguauuaaaaauagaaaguaaagagagauaucugaggguaaauuuucaaauauuugauucaacuacauaauugaggcuuguaaauaugucauaucaaauucauaaauauuuuaaaauaauacucaauuucugaugauauaaauauguauuuuuaaaauauagaaauguuauauuaauggaaaagaguaugaaauugaucauauucagaaaagagacuauaaaagacuggcuuuuaagauccuuugcaaacuauguuuuuuguuuuuauuuauuuauuuguuuguuuuguuucauuuacuauaggauuauugcuauguguggugauuacuacauugguggaaggcguuuuucuucacucucagaccuaauagguuauuacagucacguuucuuguuuacuuaaaggagaaaaauuacucuauccaguugcaccaccagagguaaguaaaacucgcaugauauaucacaacuuuuaguuuacaaaaucgauggauuguaaucuuaccaaauuucuuacauguauuagaauuuaauaaauauuuguuuuaauucuaguuauaauucuagaacaaaaaaaaugauaguuuccuucaaaacuaauauuuguauuuaaguaacuggacuuuuaaagauaauuuuguguuuauagcuuauaauaauugcuagagaagguaaauguuuauaucauaaaagguagauuaauuucuauguucucuguagcuuauuuaaggauuguuuagauuacccgaagaaaauguguuaugcguguagaguaauuuuucuaaaaauaucaaggaagagcagaaacaugucuagguucuauguagaugcucaguaaagauuacagugacuauggaauuuauaguaugcagcuauauugacuucaagcuuugugugaauuuaucuuuuuugauuuacagaaacaaucuucuuuugugugcauggguguuuguauaugucugugacuguguauacaggcuugcaugugugucaaggaaggagugcacgugcaaacuuauuacugguggcuagaauuugacaacaugucacucuugauugcucucuacuugauuacuugaagcaaagucucuggaugaaacuagagcuuuuaaauuugguuaguuuggcuugaucguuugccucagguaccccuguucguuccuccuaaaugcuggcauuacaggcagcugccauaccugucauaacuuuuaugugggcucuguagauccagcuuggauuuucaagcuugugagacuggagauuuagcuauggagacaugaagcaucuaccagcuccuaauuauuuuuacuuuucaugguuucagccaguagaagauagaaggcguguacgagccauucugcccuacacaaaaguaccagacacugaugaaauaagguauuuuauaguguuuuuuuauguagcauuugaaaagagguagacaaugaagauucauugcuuuuaaacuuggaaagauuuugaauuugagagaauauuauaggcauauaaaguuguauuuaauacucgaucuguuauuuucccaugggauggcuuaucuauucccaagguuuguaucaguguggcuacagugaaaauuacaagagaaaaacuagauuauuuuuuuaaaaaauucugagaaaguagagauuucucucauaauuugugugcuuuuauuaucuauaucuaucaauccuacucuaccuaaucuaccuauguucuaucugucugucugucugucuaucuaucuaucuaucuaucaguuuguuuuuauuccccauuacauuuaugccucagcuauaaaucuugcugaaauaauugucuuaauuuuacauaaugaguaaacaaucuuaacuuucaagaauauuguguaaucauggagcauuauaguuuuuguauguuauuugacuccuaaguuauuuauaaaacuuauaaucaaauucucuuuuuuuaaaaagcuauuuaaucauucaauagaauccuugguuuuuaacuauaaaauguuuggcuauuacugauuauauaguuucucuuugaaauaacugcaaauuauaauacaaaaauauuuuguggacuaaaaguuuuagaaauuaguauuagaaaacaaagauauaguuugaaucucaaauaaggguuucauuuuuauauaauuauugucaagcuaaugccuucucauuuaauucuuauuaccacacauuuauuuauaaaauaaugugagaaaaugaauacaauuaauaaaaaggaagaaaguuauuuaauagaaguuaguaguauugaaguguaaauuuuagaaaauuuguaaauuucaacucugaucauccaagguugcagucucuaacuuuauuucaucuaauuguucugagacucacuuagauaguccauauguuaucuugguuucuccagagaagguuuauuuuaagaauuggaacagauucaggagacucauuucuguaauuuuaaguacggaagccuggagagaccauggaagucagaguacaucccacucugaggacagaagauaagaaucagcucagaggaaacagugaggccaagggggauaaggaaaggaaacauucaucuuacuuuuauucuguucagacaguuaguggacuggaugauaacuacucuauggaggaaaacaagcuacacuagcauaauguaugaauucaaauguugauucauguagaauaguccagaaguaaugcuucauauagguugacauuccguuaacuugacacauaaaauuaaucaccaaagcccaugagauuggaauuauuuuucauugugacuucacaauaauagugcuaacguuuuggguauuaaaaacuucagguacuuuaaaguaacaacccuaaagugaucaauucuggcuaaauaaaaauagcuucauuugaugucugaaugagcaagcaaaacacauuguguucugaucuuugacuaggcaucuagaacuucuuguaguaaacaagaagauaaaacaauuccauauaggugugaugguaugguccuguuaucuuaguagcagggaaagugguucuagaaagauguauuugguuaaaugauaaaaucagcuuccauuuaucuaggaaaaucuuggguauuauuaaggaggacuuuagaauugagauggcauuaauuuuuggcuuuuggauauagaguguuuuauaaaaguucuccuuuguauaagcuuuguuuuuuaaauuugaggaaaauagagucauuuaggcaaaaacgaaagcauuuaugugugugagagaaggauugauuuaauagaacuaagguuuauaaguauugagaccauacuggaagaauauugaaaaauauaugaagauaccuuauagguguauggucaguggcagcauccaaccagaaggauauuuagagucauucauuuaauccuggaaggaaaacugcaaggaauucuuggugauuuuauauugacauacagccaacugaagccuccuugaugguguagagccugaaaacauccagguagcaaaaaggaaacuaaguagugcacauccucucugaacuacauagcagggaaaaaagcauagaugccuuuuaaccaugucugggugcuguacucuuuaaacaauaggcaucugaaucaaacaaauuuaagauguaauuauagaugcuaauuaaugcuacuuuguuucccuuucuaaaggagauacauauaaauauaaauauauauguuuuuauauuuuucaauauucuuccaguaugggcucaauacuuaauaaaccuuaguucuauuaaaucaauccucucaaacacauauauaaauauguauauauguuuauauauacauauuuauauauaucuuaaguguauauugcuuuuuauuacaucugucauacauauaauaaacaacauugaaacuuggaaacuuuaaaauucaguuuucuuggaacuacuuauaauacauaaguaauuguuuacuauuuaaaggaauuuuaguuugagucuaauauagcaaguagguaguagauagaggaauucuaauuugaauauaauccagcaaagcagacucuauuacuaaaccuauaauuaaauuguacauauaaugaaauuaggauucagguuuacugucuucaguuucacaaacaaagaugcuagaaacagcauagaacuuuguuuuuuaaguguuuuugcauauuucagauauaauaucuaaugguuuaggacuacuuaaauguucauuuuuaagauaguaauggcauuugcuauuguaguuuuuuaaaaggagauauguucauuguucacaaugaguuagaagauggauggauguggguuaccaaucuaagaacagaugagcaaggccuuauuguugaagaccuaguggaagaggugguaaguuucauuuguucuucuaaauuucagaucccaaguucuuuuuuuuuuuuuuuuuuuuuuccauuuuuuauuagguauuuaacucauuuacauuuagaucccaaguucuuuauaaaaguuuagaagucuguuuucugggucauuagacagaaauaauuuucucuugucaaaugcuuaaauucaucaaaugcaaagaaauuuuaagguguauuugguguuaauaaaugauuauuuguaaagaaauaaaguauguuaguauguuauaauacauaucugccuuugcacaaaguacuucaauauuucuaucacuuguacuuauuucgauaauuuuuuugugcuucuuuucuucauuagguauaucugacucagaauuuuaaauaguuguauguuugguauaauuuuucaaauauguguauaauucuaauaaucuuagaaauuuuuaauuguauuauucauauauaaccccaaaguucuacaguuugaauauuccccuuuguuuucuuugcuaucauacauuauuauuuaucuuaguacauaauuuaaaucaucaauauauuuagcaaauuaguacaaauuagcacucaagcaauguucaugcuuuacagacaauauucaacaccaccaaaauguauuaaacauuauaauuuuggaauuuacauuuuccucuuagauuugugugguagaauagaauggcuuucugugaucuuuuauggaaccccagaacuauguaugcccuguguggaagaugguagaguaauuuguuuugcugcuaauuguuuugucugcuuauucugacaacuagaucuugauucacaugcauaaaacauacugaggaaaguuggaaggaguuauggaaauuaugugauauauccuguauucauagucacaaacauaaugcaagaucuaggauuauaacuuccaguucuuuaaauagcauuccgaauucuacauuggaagagguauacagacaggaacaaucagauucaagcaucuuauaaauauguuaguuuuccuauaaauuuuuagauuuuguuuauguuagacuuccuuuugccuauuauacacuaauuugaauuaugcacucauugaauguuugauuuuagucuuuuuaaauacuuagugaggcccuaauuaagagaaguccuuguauacuuuuuuuuuuucuuucauuaucuguucauugaaaacucuguauaaacuguuaggacuagaauucaaccaauacuuaguaaaaacuaugaauguauaaggauaggcaggauuacauagggagaugucucaaaaauaaaacaaaacaaaaacaacaaacaagacaacaauacacucuggaguacaaacuauacuaagguuaaguuuguaauacgguuuuaaaaaaaggaggaugcauguuauaauccacagaaaagaaaguucucacuuuuuagggucaaaauguuucacugugaagagauagcauuugagguaguuuaccuuaauaguuugcuuuuuaagaauagguagcaaugaguugaaaggacauuuugauagugacaaucauaacagaaggcaaaccagaguaguaaugugagguugguuagcaaauggguaguuaggugugacagauagaaaaugggugggaugaggcaggaaaugcacacgagcauuugagaccugugcuuaagaggauugcuuguaaaaagagaaauuuguaggcaagagagccaaauuaaagguuuggcuucaaaauuuugcauucauuugauugguuuacucuuaagugcacauuuacaauggaaacuaaugaauucagagagguuggaguagggcacaguaauaauuauagaauagaaacauucuccuauacauguaacuaugaaagguacuauggagaaagauuugaagaucugauucuuaggaauuuucaugaaauuauauuaggauuuaauuuuauaaaauucugucuuaaugucuuuccuuuagggccgagaagaagauccacacgaaggcaaaaugugaguuuuuauuaauuuuuuuaaaagaaaaaaucauaaauuagaaaauagucagcauacuuaaugacuuuuuuuagauuaacauuuuuuuuuaaaucugauucaaauaacugauauauaaauuucuuucuuuuuuuuuuuuuuugguuuuucgagacaggguuucucuguguagcccuggcuguccuggaacucacucuguagaucagacuggccuugaacucagaaauccgccugucucugcaucccaugugcugaaauuaaaggcgugcgccaccacgcccggcuauauaaauauuucuuaaggagcuaguacuaaauuuuuuuuuaguaagaauuuuaagcaaauauuggccuauaccuauauucaaaucucauaucaccaaacuaaaagacuuucugguaaacauuauguuugaaucauaaugggcucauauuucucuucauuuucuuacugacuacaguauuucuuauuuuuuguggccauaucauuaaugaacuuuuaaauucacuuuuuauccuuaauaugugagauaacuaaaaauuuuaguauaacuaaguaaaguccuuuuaaauaaucuuuuugcguguaugagauuccuuuuaaaaucuuaagccuuuaauccuguucuggucauauuauuucaauagaauauauaccuguuaauuuuacagugcauuuuuccccuaaccaagcucucagcauuuauagauggaauuuaaaacuugccucaaauguuuuauuuuccuguuaucuagccauuagaaaauagauacauuaaucugaguauucuauauguaguuuucuuaguuuccugucuuaauagaauauauauuaugaguacauaguuauaauacuccaugcagguacaagugacuccauuauucuaacuguaccuaguucuaucagcaguuucaaaugcuaguuaauccuugaagagcaugagauucauaacaaaagcagauuauauuauguguuuguguauauaugcauauuuuauauuuuccaaacacaguaauacuguucuguauuauauaaacccuugacagagaccacagugcaaagaacaauuucuuucccucuugucagaagacaauuaccugagugguagcaaaugguaauugacauucauugccuaauaauacagauuuugagaaguagaaaacuauaaaguuuuuugugugucuuaagguaaccacucugucuaguuaauguguguuagaaugugaauucauugggcagguaacauggcucagcauguagaagcauuugcugcuagaucugaucaccuacauuugauccgcaggacccaacaaauuauccucugacuuccacgugcauaucaugauguccacauacuuaaaacacauaugcacacacucucucuuuugcuugcucgcuugcauacacgugcuugcacacacacacacacacacacacacacuaaauuaaucugaauucaguauuaugaaauccuucagauuuucccuuguaucuguuuuaauaguacagauuuaagaugccaguaaauauuuaaaaugcauucauuuuucagugucaaauauaagacuucacugggaagucauauuaauacguguaagucuuuuguuuuucugaacuuuauauuuauguggaauuuagcauaaguuaaauuuguauugguuuauuuuaaguaccugccuagucucuuuaaguauuuaaaguagagacuauggcagugaaauaucauaauugucuaaaguauccuuagucacagugaaucccuuugagauucaauagcugguuugacaguuuuuauuguuuuguuuuuuguuuuuguuuuguguuuuugagcuccauaucuguguggguauuaaguucuaguacauuuuuucuccuaaaauauuuauugaaugagucccuacuuuucagucuuaaauaguuuuaugauagucgcucuuccuagugccugccacagcagucaucuucuucugggcccuccaaguugucagucaucucacacucucugcuccagcacuuagaauggcuugucuaaaauucccaucagaaauuauacuuucucaacuaaaaucccgaacucauucccuaccaacuucacuucagcagaucuuaaaaugauggucugugaugcacaugcuucuuguaacuuacugccuuuucauuucacucuucccuuuguagaccuuguaaaugcauaacuauuuuuaaugauuauuaagcuguuucccagucugggauuaccugcaguuguuuauguauuuaauuaugggauugaguacuuuaaguugagugacuguucaugcuuuuccuuacauaugcugacgacuugguacauuucucuguuagucuccaaaugcccuagcacaugccuaucacuguaucacuguacuuucuguauuuuacaugguuuucaguuguucccuuuguuuuuccuauaaccagagucuggacuucuuaagagcaaggacuuaccuguuaccuugaguccaaguuauguaauugaauauauaaguuuuacauaagaauaacugugggaaauaaucuuaccccugugccucaaggcuauuuucucagugcucaaaauauuauucaucuuugucucuuuuuuuaaacuguauucuuuggguuuauauuuuuacaagcuagaaaacuguagaguuagucuuggaagccaucuagcuaagucuucuacaguauggaaauccacucuguaguaaaugguaauuuaaucuuuacuugagugcauacauuuuaaagcaguucauuugcuuuucauuauuuacaucuauacugagaacaucaggaaaucugaguuaaugauuacuuuuucauuuacuuaaaaauuaaguuguauuuuaacuuucccuaguaauagaauaauaugaagcagaaugaaugaccucuaagccuaaagccauugcaucuuagagcacuuaggcuuuuagucuuguaguauauguacuuuacagcuggccguuaacucauuacuacaaaucacuguagacauuaagaagauguagcaaagugguagagaaguguucugacauaaccagcaagagaaaaugagauguaauguaaauaagaggaaaaaucaauagaccuuuggcuuuuaaauuuuaguuuuugagacaagaucucacuuguccugacugcccuggaucucacuaugcagaccucagagcacagugaucuccuuccucugucucccagguucugggauuaaauacaugcaccaccauuccugauccuuaaguaauuuuuuaacauguuauuuuaugaaaaggaaaauauuagauaccuuucuaauuucauucuccuacauaguucguucuguuaguauguacuuguucugguguuuacauuuuaauuuuacuaggcaagaucuuauguuaaaagaaaauuauuuuugaaggaagaagcaugagaaaacauuuggaggccuuguauaauuuuugccuuauauaauuuucucuauccuucccaagccauucaaagaaaaauggagcuauguuauaagcaugugacaauuacuacuaaaacuaaaaccauugcucuuaaaaauauuguaauuaauacgguaauuguagccuauacuugacaguuccuaguguguccauacuuuguugagauaaagcacaauaaguuugcaaaacgcaauagaaauguaacaaaugacaauuugaccauuuccaugacauuuguuucaucagcuugguuaccuuugaguauaugaaagcagcaccauguggacuuuugauuuaaauaucuaauuuguucuccuuuuaagaugguuccacgggaaaauuuccaaacaagaagcuuauaauuuauuaaugacagguaccuuuguauucuuuaauaucuuuauaaaguauaaaauugaaacagccauuuuuaauguacuauaguuuuuuuuuuucuagcauuugauaauacaugcauacuguuauuucuuuccaaugcugggcaauaggaguugguauuuucugguuuuguuuuaauuugaaauguacauguaagcucuuuuggaauauauuuuucuucuuuucuauccacuguccauguuuccuuuccccuauuuuauaccuuacaaucuugugauauacuuuuuuauguauauuaggucuguccuacauauaacacacuuagaagaauacauaauauacucuuuaauguuuagacaagguuucucuguguaauaguccuggcugucauugaaaucgcuuuauagaccagguuggucuugaagucacagaucuacuuaguugccucugcuuccaacuguuaaauuaaaggcaugugucaauauauauucuuguaugccugguggaauuacauaauugaaccuuauuugauauuaaauuucuaauuacuaugauuguucagggaagaauaaauuaaauuuacuuauauuauggguuuauaauuuaaagcagggguuuucaaccugugaguugugaccccuuugacaaaccuuuaucuccaaaaauauuuacauuaaaauucacaucaauagugaaauuaguuaugaaguagcagcgaaaauaauuugaugguugcaggucacuacaccaugggaacuauauuaaagggucacagcauuaggaagaaccacugauuaccagcuauguuacuucagucuuuauuauuaacugcucaucucuagguuaauuuauuaguaaacaaugccugacaaacauuugggacaaaaaucaaucaauguauuuuagauguugugguucuugaaaaauugguaguucaucuauuuucuaggguaccuggaaauaggcuauuauaguaaauaaacuacuaauuguuaaauaugugaucugaguuguuuaaagauauaaggcauuacauuuuuaaaucaaugauuugcucucauugguuuugaaguaauuuuugaaguacuuaauggauuuaauaaccagcauuaaguagauccagaauauaauuuaaaacacaacaaugcuauaugguagaaauagaaaucaaauuuaaaccacagaaguaugccauuagcuuucaagguggaaccauaaauacuuauuuuagucaguuguuggaguagguuuauauuuagauaccgaaucgccaaguauuugaaguacccaguauuguuuuagcuguguaaacaugaaaauagccuaaaccuaguuucucccauuagagucuauuuuuguucauucauauucucuuuuugaaagagugcaaacgucacccccagaauuucacaaacauacucauuuacaaacuuguagaagaaacagagaguaucagaaucaucaccaagagguuuuuuuuuuuaauccuacauuaaaucacauaguuugcaauuuaaauuuacuuauauauuaaguugagccaugaaaacccaauauaaaaagaauuauuuuuuacuucuuuguauugaguaccaaguuacuugauagcaagagccccagcuagaugauugaaacaauuacugauucguauaagaauuacaugugauaauuauguugguuaugcuuucuuaaaagagucagcucaugaucuuucuguuaccaguacuccaucacaaaggaaagauagucuuaggaguccuugucaauuguagauaguccuuucuguaugccuucucaggaucauaccuagugaauaaaguaucauguguguguauuaacuuaugauaguauacucagguacuuaaguuauuugccucuguaaguucuuacauaaguauauuauauuauuaauuggaaauuauuaaauuaaauuauuaauuggaaaucuggggaaauuaggcaaaauuaguuuaacuuucaacaucuucuuuaggagauuaacagaugaugcaacaguuuuaguuccuguuacugucaggagaguucuuucagagagcgaaggguguagauacacuccagaaguuauuguacagaauuucuguuccauaugcuuguguuacacugagaauaacaugggugguuugaaacauaaaaugaaaauaguaaaaguuuuauuauaaaauuuuacaugugauugaacuuaauaauuacuuaacauacuuucucucugauaauuagaguauaaaacuaacagcuuaauuuuuacaguuggacaagucugcagcuuucuugugaggcccucagauaauacuccuggagauuauucucuguauuuucggaccaaugaaaauauucagcgauuuaaaauuuguccaacaccuaacaaccaguuuaugaugggaggccgcuauuauaacagguaaauuaagcgacagcuuguggugaaaauaguuggaaucaaaauauacagauuuccucaauuucugguauaauuguaauagucuuuuaugagaaugcuuuaaacagugucaaacaugauuguuaauaacuuuucaacucccaaaugucuuguuguuuaaucaaguauuuauguacaagcuauuuguauguaauucucuaggagucaucugauuuuuuuuacaaaugccauuauguuauuggauuauugucucaaguugauacauuuuguaugucugauuuguuucugcuucucaacuccuagaaaacuuuguuucaggcucacagugagucucacugcuugcuuaggaaagugauuauauuaauacagugauauguaauauagagugacagcauuguucuggaaaggagaaagggugaaacauuugcucacuuugaccguguuauuucuucuuuuggaagcugguaugaucuauuuuuaaaaauguauuuaccugcuuuuuaauacugaccuaauauuccccaccucaauuagaauucccuaaguucuaguuugaguuucaaauucauaagccucaacagcugauuaucuggaaaacagaaauucaaggauaagaucuuuugcucaucagaaguucaguggacaguuaaaaaaaauuaaaugaaagauguaauuauagacauuugcguaucucaucguauuacgcuaccugaguuccuuuaauguuauaaucuaggcuuagacaucuucaccuaggauccagcuugcuaggcauacuuuaguauucuguuuuccucuuagacuuuuugcuuuguuucgcgaagcaauuugagcuacuuuggaaaaggagaggcauuuagcaccaaauugaauucagcagauauuuauugacugauuauuuagugaaaucuacugugcuguguacacaugaaagaagaaaaagacccauuucuacauuauuuaguacuccaaaguguuagaaaagauguucacuuugugaugaauugaaggaaaauacaaauaggcuugagaaccaccaaaaggcuacaauuucgguaaauaguaaaagggaagcagugagguuuuaguaacacauugaagaguaacaucuguguagggcuuaggaagaggugugcauaguuuuauguaauaugcacuaaauuaaaguaccuggcaugguggcuuuagaaauuuguuuuauagauaggccccccuccccccagcggcuacaguaacugaagaaaauaccuuucuuuucuguagcaacuauuaauuggcuguauauccucagggagggauugcuccucgggagcccuucgcuuuuccauggcaggguguuuaaagauugaaucuuguacggugguguacagguaguacuugaugggaguuuaugaauacaaggccacgcaugccauaacuggaagacagcagccuacaacacugcauccguucauucagcucuuacauucauucuaacccuuucacaguguuucuugaauuuggggugggagauaucaaguuuuagcugcaguuucaacagauauuuauuuguguugugagucucagcaguaacuguagagcacugugaaagaagcuucguuggccaaagcugaugugauagcagcacuaaucucugggaaugaacacauuauuuagaagcaaauuuguuuuguuucuaagacagggucucguucuguagcccagacuguccugguaauguguagaccuugcucaaccuuacuugagcucacaguauucaccugucucuacaugccaagugcugauuuaaaggagugugcuacuacgcuugcugagaaggaaaucugguuguacaucaugugcaguucacaaaacagcagcuguagcuucuuccuugcuagagccuaagacuggugcagucaugaacuuggucagguuuauaguaccacaugugaguuuccuccuaugaaccaguccucagguccuuucagaaaauuguuggcuaacacuauaauagucucaucccacugaacauaucuugccuguagguugggaauguagcacagcaggcacacaacugaaacuuggugacaguucuucccagcuacuugcauagcaauuucuagaacucauagagccacacaggagagaagaagcuuauaacuuuguuuccacuuuauuucucaguguuacagguguggugguuucagaauaccauguaugucucaugaucaauaauaauaaaugugcuggcuuacauuguuuuggaggcuuuaaaaaaugagcccaccucuagcacaguauuuuucuucuaauaaucuguggcuuuggagaauagcuuuauccacccacacaguguacuuccauucaagcuuuuuaaauuuuuauuuuaaauuaucuuucugaggaucacuuauauauuuaaaacauacuaauuauaaaaacuauuggguuucacuguuacauuuccaugccugcauuuaccaugauuaugucuaccuuuucaugcauacaaaaggcuuuggccuuuauuaauuuucauagauaaaugauacauuuuacuuuacaacacagucaucuuuguggugguaucuggcugcuuucaguuuuuuuucugauuuucguuuuucuuuaaauaguuuuagauuuauccuauuuucaauuuuuuuuuaacauggucucuuaaaaauugauuuuaucuguuuuuauuucuccuucccaucuguuaauauguacaugcguuuaauuaucuuuuacaauuucuauauuuuacuuguggcuauuauauuuaaauuaauuuuguaauauaggagagauacuuggaacuguagacacaacauauacacauaaaauauuacaguuauucugccacugaagaacuaugaaaagaauaaaucaaggggcagguuaacaaaaucuuguuagaaaucuauuacuugggagccuuaaaaauacucauccauuuaguauacacaauaaaaauuucaaauuccagaaauuaaauauuagaaauuaauggagccuauuaauaacagaucacacuuuuauuuauuacaaaaaauauuuaguggcacuccuaaacuuuguguuauauuaugucauuuuacuuucaguuucaucuguaauauguuccaaauauauggagaaguugaugauacuuuuuaaucaaagucaucuaauccaccaugccauagagacaacuguacagggggauuaacucuuaguuuuucuuuuucuuucuuuuauuagauauuuucuuuauuuccauuucaaauguuauccccuuuccugguuucgcccccaaaaucacccuauccccucccuccucccccugcugaccagcccacccacuucugcuuccuggcccuggcauuccccuacacuggggcauagagccugcacaggaccaagggccucuccucccacugaugucugacaaggccauacucugcuacucugcuggagccauggguccuuccauguguacucuuugguugguuggugguuuagucccuggaagcucuggggguacuaguuaguucauaugguuauuccuaugggacugcaaaccccuucagcuccuuggguccuuucucuagcuccuuuauuggggacccugugcucaguccaauggauggcugugagcaucuaccucuguauuugucaggcacugguggagccucucaggagacagcuaucucaggcuccugucagaagguacuuguugucauccacaacagugucuguguuuguugauuuuauauggaauggauccccagguggggcagucucuggauuccuucagucugcuccauacuuuguaacucuaucuauggguauuuuguucccuaucuaagaaggaucgaaguauccacacuuugguuauccuucuucuugaguuucaucuaguuugugaauuguaucuuggguauucuaagcuuuagggcuaauauuaucagugagugcauaccaugaguuuuucauuuauuauccuugacaggcuggauaugagagauauuguguaaauugguuuuugucauggaauaucuugguuucuucaucuaugguuauugagcauuuuacuggguauaguagucugggcuggcauuuguguucucuuagggucuguaugagaucugcccaggaucuucugacuuuccuaguuuuuggcaagaagucugguguaauucugauaggucuaccuuuauauguuacuugaccuuuuuccugaacuccuuuuaauauucuuucuuuguuuugugcauuugguguuuugacuauuaugugaugggaggacuuucuuuucugauuccauuccauuugguguucuguaggcuucuuguauguucaugggcaucucuuucuguagguuagggaaguuuucuaauauaauuuuguugaagauauuuacuggcccuucagguugggaaucuucgugcucuuuuauaccugguauccuuaggcguggucuucucauuguguccuggauuuucugguuuugagcuagaauuuuuuugcauuuugcauuuucuuugauuguuguauuuucuauaguaucuucugagccugagauucucucuucuauuucuuguauucuguuggugaugcuugcauuuauuacuucuaaucucuuuccuagauuuucuaucuccagaguggucuuccuuugugauuucuuuauuguuucuccuuccauuuuuagauccuggaugguuuuguucaauuccuucaccuguuugguuguguuuuccuguaauucuuuaagggauuuuuguguuuccuguuuaagggcuucuaacuguuuaccugcguucuccuguauuucuuuaagggaguuauuuaugucuguccuaaaauccucuaucagcaucaugagauacgauuuuaaauccgaaucuugcuuuucugguauguuguggaaucuagaacuugcuguggugggagaacuggguuuugauggugccaaguugucuugguuucuguuggaaagaaucuuggguuugccuuuugccaucugguaaucucugguguuagauguucuagcugucucuggcuggagcuugucccuccugugggucuguaagccugugcccgaacuccuaggaaccagcuccuuccuggaggagcucggguacagagggcucuggaacugcccaagcucugggugcccagcugcuccacuguucuugacacccgugugcuccucuccuugcugcccagcuccagccaguuauuggagagaaaguggguucuccuggccagaccagugcacagcaggcuguggaucugccucggcucaggggugcacauggcaauccugaaggauugugacccggcugcuccacuguuccuauguucugcuggcuacuggcugacaguggcuaucucacaaccgagccuaggagugaaaacgcuccugaaagaauaggucucuccugugggguccuguguacaggcuguggaacagccucagcucacgggugcagauggcaaaacggguaguuuuccuuuuuauucuucaacaucuauuucuacuuaaauauucauguuuuuaucuuagugauaaugaaauuuuauacaaaaucaaguauauaagugaagugauuuaauguaaaaaauucuuaguuuauuauuugcuaaauaaacaccauuuuuguucuucacuuucaugucugaaggauugguuuuuaacccccccaaaacaaacaaacccagauuguccuuauuuucucauggaaugucacuuucugaguauggagcuccauucaugguugcuugcauguuugauauauaugugaaccagaaucuuuaacuuauguauuccaaccugugaaccuguauuuguaacauucagauuuucuauaauaaugugacuauuauguuaauucuaugaauauauucagauuauauguauucaaaaauuucugaauagauaauccuugguaacaagguguauucuaagagauuuacacaauuauuuuauuuuaacaguaucggggacaucauagaccauuaucggaaagaacagauuguugaaggcuauuaucuuaaggaaccuguaccaaugcaggucagcauuauuauuauuauuuugcuugcaauaauuggcaucuuguuuucaaaauuuuuuugugaugguuguacaagcauucuucuaaaacuacauaaaauuuaaaacuacugauugcuugguuuccuuuagaaaauuaauuguaagggaacugauuaauuuucaauuuuguuaagucaguagauaauuaguaaguccuuguaauaaucaaagaaacuuuaaggugguacucuuugaauguuucaaaaaugguuauuauaaaacaaauguauauauaagcaguuaaauguuagugauaguauacuguguuagucuuggaaugaauguagguuucagcagaaggcugaagacucauaacauauacaccuguuucauaauuggcaguccauuagaaaauacaauuuuuuuucuaaugaacaaccugaucagcuugcacaaucaaguuaacccuccccucuauguacccuaaauaccaagacaucagcuaaaauagaaacaagccaguacuagaauuaguacuucauguuaaaggcgcuagaggaaaaacagcugaugagguggcucaggagguaagguacugugcuuugagccugacuaacugaguucagucccagcacucacucaauggaagaaggauccucugaccuccacauguacgcuguguuaugugagcagccucuugcucuuaaacagacaacauaaagaaaaacauuaaaaaauucaaaauucuaaaaauacuucauuuuagguauuuuucuauaauauaguaauuaauuauuccaacaauuuugucaaguuaauccuauaaucauccuauuuuacaaauaacaaaacuuaaacuagaaaggcuaaguauauuucucaagucacugagucauauuugguuguuuucccccuauuuacuguguugggaauauccuucuugcucugaacucaaaauacguucagaacccaaacaccacaaaaaaugauuuauuucuuugugugugccuuuguccuuuauagcauguaagaguuagacauuuaaaaugugaguuggaugcaagauguuuaauauuucagaauaaaugauaaaaaauaccuuugguggcagacagaaaacuauacuggaauuucaguguuacccacauaccuauuuuuuucugucuucaugucgucuguucccugaauucugcucuguuugggguuuguuuuguuuguugagacaggguuaccuugacuguccuggaagcuugcucuguagaacaggcuggcuuugagcucacagagauccuccugcuucugcaggggaguuggaauuaaucgcauaugccaacagagccuguccuguugaagacuguuaaacauguuaggcucuuugccuccuuuggaucuaugagcuagguuuucccucagacaucuacuuaccuuuucuuaguuauacaaaguuuacccccccccccaaaaaaaagcuucauaugagacuuagagacaaguacuucuuugcaaagcagucuacaucuuuuacuguauaauuuacuucauauauuuacugacuuccucuaauuagaacauagugaucuguaaugaguguagauuguugacuugaaguguuaaaugauguuuuccuagucaucgaguaauagaauugaaguuuggcuacagccugugcauucucaguuuacccacuaguuucaagaaggacuguauaaguugagauuuucuuguucagaacuauguagaaagugggucagagugagggacacaugccuuguuaucauuuagugauuuauuacaaccuacaagugaagcuuuauucuuacuggcaucauuuauuaacuuguaggucacuauaucuuaauuuaauauuuaauaaagcuagagaguucaguuaguacagugcuuaugauauaaacauaagaacaauuugauuuccaagugucuacuuaaaaaaaaaaccuguaugcaguagagugcaacaauaaucccagcaccaacuaaagguagagagagaaggaucuugagcucucuagccuaccagucuugcugaauuggcaggaucucuguugagggagauacagugucucacaaaguaagguggaaaaugauugggaaaggccuuguccucaggccuccacaucuagacacaccuacauacauagaaacacguaacacguaaaaauuaccuugaagucaagaaugugguaugucuuaaauuauuggagugccacauucuacagcuaauacaaagacaaucaccaaacaaugguacaaguuuguauuaaacuaguaaauuagucauuacuaauuaucaucugugguucacuaaaacuuuuuguacaaaaacagaaaacuggguuugggggugggguaccugaugauauaacuaaguaguacagcacuugccucauauugcagaaugcacuagguucaaacuacaguacuucaaaucagcaacaaaguaaaagagauaauggguugaauuuagcauguaagacaguuugucaccuuuauuggagguaaguaaugcuuccguuucuuaacauuuuagugccugggcaugacugcugaauaaggaaaugaaauagcagaaugucuuaaaauagaaaggugaucaugaagauaacuuaauauucuauauuugcaagaaguugaauagacacacaaagccuccccaaaggcuagauacuauaaaauaguaauauuucagaaauaaaagaacuacuauaaagaaaugggaauaccaaaauuuaguucuguauauguuaauacauuugaauauuaguuuauuugugaaggucaugauuacuuuauauuuguaaggguuauaauauggugcuuuaaaaugaaaaaagaugugaguuuuuuuguuucggaaguggcuaucaaagugguggaacaaaagaaagcuauuaaguaguaggaagaaaaguauuuuaaauccgacaguuuagaaauagcaggugaagacguaaugaugcgcugcuguaucguguguggugaacugaggguuaagauggggguguguccugauucaaguggggaguggucuaguuguacaugguguuucucagaguuaaagaacauucacaaacauugccuccugacuugcaaguuaauucuuggauaaguagaucaaaacuguaucauuugccauaaaauuuaacaacaagcugaaugagguuuaaaauagcauuuaaguacccauggagcuaaagggaucugcaacccuauaggaggaacaacaauacgaacuaaccacuaccccccagagcugugucucuagcugcauauguagcagaagauggccuaauuggccaucaaugggaggagagccccuuggucuugugaagguuauaugccccaauacaggggaaugccagggccaggaagcuggaguagguggguucaggagcagggcagggggaggagauuggggaguuuuggauaggaaacuaggaaaggggauagcauuugaaauguaaaugaagaaaauaucuaauaaaaaaaaaaacccggcauuuguccaugagacauuguucuuaagaaaugauaaaccuuucugagauuuucuuuggaagacauauuuugguuuuaguauuuuagacauguuuucaccuuguuuuuaauuaguaauugcauauauuucauaaauaacuuuaaugguuuuauaacucaggaucaagggcaaguacugaacgacacuguggaugggaaggagaucuauaacacaauucgucggaagacaaaggaugcuuuuuauaaaaauauuguuaaaaaagguuaucuucugaagaaggguaaggaaacucuuaagacuaaggauuuaauguaggauuuuaauauuauauauaaaacuuacugcaagacaucaguuuugucauggguuauuaguaacaaguauuuguucagagcuuccacauagaauguuugaaauuuagguuuaguuaauuaaauccacauauaaccaggguuuuagaacaagcuuacauuuuuaaaagugugccacuauaucuugacuuaauuucaggcucucaccuauggauucuuaagagaaaauccuuguggcacguggacuucacaguacuaaacuuuuauuuauaaaucuaccucaguuuuauauuaaguuauugagguagauauuggugguaaaccaugacucuaaaacaagaauuuuaaacauuauaauaaugaaauaucaaaagauaaaguuaaaauauucuaaugaacucuaccauuuauuaauuuauuaaacaagcaauaauaaguauuuuucuacauguuagaggcauuuuguaauuacacagggauugaucuauucuuuaaacuuacaaugaaaauugaaauguauuuaauuuuguauucugaaaaugugauuucauaguuccuaaggaaagauacuauuuuuuaacagguaaaggaaaacguuggaaaaauuuauauuuuaucuuagaaggcagugaugcucaacuuauuuauuuugaaagugaaaaacgagcuacaaaaccaaaagggcuaauagaccuuaguguguguucugucuacguuguccaugacagucucuucggcagguaagacagugcuuuucuuaacuguuuuaauaauaaaaauaguagauauuuucagaccauuuucaaauaugaccuguuuuaagagcauaaaauuaccuaaacuuauuuaccgguaaguuuuuuucucagcuuuugucuaagcuguaugugcaauuugauucuuagguagauauggauggaauggcuucucaguaguagaacuagcuacuaaauauuucauaaauucacuugacuuugcuauucuuuuuauuuuaaaacaaaacaacaugcugauaaggauaagaaaugcacaccuaaaauacucacaauaugaaaggcuagguuggaacaagguggcagaaaaaccccuuucaagucauucucucuccauacucacuaaaaaacuauucauguauaagugucuuuacuagagcucaagaaaucagaggaaaacagaauguuugguuuauaaaucacaagaaagauucauugaaggagacaggauggacaugugugucacuuuguucucaguuauaaggagaaggagaaguguuuccagugucuagagaggacugaggacaggccugagacuuuacccaauuaaggcgaaauuaaacccaacauuuccugaaaauaagcaauauggggcugguuuugucuguagaucugaauucagauaaaacaauuuuauuuuagaaaacaaaaagaaacaaaacaaaaaugaaggcuguaaugaaauccaagguguuuuagccucggguuuuuuguuuuuguaugaagaaaagggaucagacuaugacuguuugauacaagaguuaaaaaauauguucuguaggaaaaacucucuuuguggggguaacucuaagucacauuuauugaauaaggagugaauuucuaacuauagaaccaaacugucauguucugacaguuggaaagcaguaaauagacauuuagcaucacuguaucaucauuuauugcuucuaguguacagcugcuuguagaaauuguuuauauacuuuaaauguuaccuuaguuaugaauauuuaaugaugccaggucugaaacuuuaugaaaaguuaugucuauaaaacgaagcucaaauuuuaaucucugcuccugaaauaggccaguuuagugucuacuuuuuauuguaugugcuguuuuuggagagugaccaggaaaacagaucagcaauuuucuguuucuuauauuuucuagcuguuuuucaugaaacucauacagaugcuccaucuaugacacaaggagucaguugcucauucccagacugaacaauaaugugucuucauuaaccauagcacacugcauuaagaagcaucucugaguucuuuaaccauauuauagcuuugcugucuuccaucauuuucacugacacuucaauuuuuuucucuuagauauauuauuuauuuauuugugcuaauuaauccuuuucuggaugcuuugaaggguuuuccuuuaacaaaaccagaauaggccuauugcuauauauuuuuuuuaauucuaaugauuauaguuucuuaaaugaaagaucuguugucuuuucucagcuuuaggaaaauacuuguuggcauauuuuugcagugcuucugcaaaauuucaucuaggaucugcaugugucaugacccauguaguuaaauguauggguuguuuguguuuuacaucuacucuuaggaucuuuucuucaaccuagguauguccuuuugauggcucacuucgcuaaucuauuuaucuucaguuaaguucucugauucauuuuauugaucacauuuuaaguugagaaguuaaauuuuuuuguagaucgaguucuucauccguacugguuuuguuuguucauucguuuuaagauuuaaguuuuaccuacuuguaaacuguauuuggcuauuuguccucugcuguccuuuuccuuuucacuuuucauuuguuucugguucuuauaucugcuuauguuugcaugaaugacagacaccuugugugaaaagcuuugaaugauguuacugcuuccggaagguauuguucuuacgcccuauggugaccaaguaaagacugaguucugaaguugggaaacucagccucacuuugguuuugccuucuuaugugacaauguagucauuuugaggugucugauacaaaaguuuguucauugaggggccuaaguuccauuuuccuucccaaucaugguggaacaucuggggauuuuuggauagcuuuucacuugcugcuuucugcuuagcacaucagcuucauugcuuuuggccauucccacauaucacauggaaagguuugaaaagaaacuguauggggaaugucaauuucguuucauagugagcuuauccuucaaauuucgcaauguaugcuguucuucauaucuucacauuuguuuguuauuacuguacauuuucccagucuagauagauaguuguaaucacauuauacuucaauuagauuacuauauauuuaaauuagaaauucucaguucauaauuuuccauuauuuuaguaucuccccaaagcaugauaaaaaucuuugucuacaguacaaagaaaugcuuaccgaguucugaacacuuccuuguuaaacauuuuauuaagcaauuucaaguuuauuucauacuggaggaagauauaaacagacacuguagucauuaaacuacagagcaagcgguauagcagagaugguguuucugauuuaauagauuaaaaaaaaacaagacuguaaaauacuugaaaauagaaaacuauaaugcaaacaauucaaacucuagucugcuuagagauaagcauuaacauuuuucaaguaagaacauuucuuuuuacuuuucagagaaugcacagugucuguuuauuaauuaaguguaauucuagaaauucuacuuaaacguuuuuaucacuuuucucuuuguaaugaaguuuaauauuaguuuugcccuuuauuuuaaauguugaaauuuauaaaugauauuuuaauuugguagaacgaaauaccaacuucucuaaauuaaaaauuauaacaaucuuaaauuacacuuuguggcuuuuaaaaguugguguaaauauuuuauaaguuucuaaauaauuuuucuucuuuuuuuuuccuguguugugugcauguguuccaaggccaaacuguuuucagauaguaguucagcacuuuagugaagaacauuacaucuuuuacuuugcaggagaaacuccagaacaagcagagguaagaucacuuuuuccuaaacuauuaauaucuuuguauuagccuaauuuuccuuauuaacuugcauacaaaacuaccauaguacagaauuaugaaagcaugucuaaagugguaguauuuuaauaaaugagaaacuccaugucaaaguuuuuguuaauaguuuuuagcauuuuuuucuuuuuaauacacauagacauacacacagacacauguacagugaaguguuaugaggaaugaaaauugcccuuuaaaauugaccauuaaguaaucuaugaauucaguugaaacuaaucauuucauuacauuuccauaagucaguauaaucuaaaagaaagccaguuguaauauuucagaguauuuaacuguauuuuguacagauauggcuguuuucugaggaaacucugaaaaauaaauuagaucaaaaaaugaacgugucugggaauagaacaucaucugccaggccuagaaugaaccaaaugaccauaauacuuuagauccuaaguaggcccuuugacuuaaaaauuuuguuuuuuguuucacuuugguaggacagaaagaaauuauaauguaguauauuuugagaguaggacuugcaggguaugaauggcaaauaauaaauauaaaaaagauaauuugauaauugcauaaacuuaugucugcuucuuucuaaugcuuuguuucuguuuauguuuuuugugaguguaggauuggaugaaaggucugcaagcauuuugcaguuuacggaaaaguagcccagggacaucuaauaaacgccuucgucaggugaaacuucauuuugucugacuuguaauaauuaauuuucuuuuuacuuugcuguuuuuuucuaugcaugcuauuuuuuccuaacauuucucaagaguagaaagguuuuagucuuucaggcauuuuauagcuuugcuguaaauggauauuucuaggaagcuuguugauuuuaacauacuauuuuauuggaaguauauaaaauaguuguuucuuuagguaacuaaauacucuuuguaauauaaaaccuggguuuugucccaaggacauuuaauuguauuugugauuuaaguauucaauauacugaaauugucacauauauuuguccauguaaaaucagagcuaauaucgugaaucccuuggauaugucaguuccucugcuguguggcuauggauuguucccagucauuaacauauagucgucuacauguaugaaaaaggagaggcuccgagacugacuuguaggaggugacauaacugauguagagaaaacaauaguaguggucaugucguaggcacccaaacuggugauaaguuaguuucuuggaauuacugucguuuuugaaaugucaaaagguaaaauuggugucuuagaauaccuuaaccaugagacucuuacuagaauagugaaaucuuaauguaagcauaugguugcuuauacuguacauuacauguaagcauguuuauuccauguuuguaguuuucauuuggaugaugguaguugauuagcaaagcuuauguuuucuuuuaaauauuaaggaaaaaagucuuuuuuuuuuuuauuuaaaagccucauauucaggucuugaaauguuggauaugaauuuuuguguucucuuuaggucagcagccuuguuuuacauauugaagaagcccauaaacuaccaguaaaacacuuuacuaauccauauuguaacaucuacuugaauagcguccaaguagcaaaaacucaugcaagggaggggcaaaacccaguauggucagaggaguuugucuuugaguaagucauaucuugucauauucaaucaguuuuuacaaucauaauuacauuuuccuccuacuguuuauauauaaucuguuuaaguuucuauuguuuucuagguguuuuaauaguauuuucucuuagcuucuuucauauuugaauuacucaaaaacaauaacaaaaugcuuucuguauuuccuaauuuuguuuuaaugaauuauuaauccuguuuuaaaucuaacacacugaacuguuaaaaaagaaauaagguaguuugauacuacaacauuuuucuaauuuuuuuccuugcuucuuuagugaucuuccuccugacaucaauagauuugaaaucacacuuaguaauaaaacaaagaaaagcaaagauccagauaucuguaaguugaauaugaagcuuucuaaaguaauaaaagcauauuguauauauuuuuagaauuuaugugucaaaauggaagugaaacacaugcuauauaacaguuugcuucuaaauauuguucagaagggauuaugaaggaaagaaaaaacaaaacgacuaaaguguauguacuguaaguccuuacaacuuaaaauauacaaaugcccacuuuccuguucccaaagaacaagaugagaaaaugguaguggugauuauuuuuuuauugucuuuacuuuuuuaguguucccucauuuccuacacugcacauauuaaagguacuguuaauacuagagcuguaacucagugguagaguauuugucuagcuugcugaggauuaaaaccuaaaccugcaaagauaaagaaaaaaaaacauacacagaaaauuuaggugcuuaauagcagaugcuccgauccuauucuaagcaguacauuuuugauaggauagauagaugacagugugaucuaacgauucacaucggggugacuuagguuuaugucuucuuacaauucaggguuuuaggguaaacaguaauaugccagaucaaaugacauguaccucucugaauaaaauguuuagucuguaauugcauaccuuuuuaaaagaauguuuuucuccauuacuuauaugauaacauugcaguaauggcacagaaaaaugucauacuuucuauuuggauguggucuucauuccucucccuugauaccucacuagcuaucucaacauacuuuucuguuuggaagagacuuuuaacucuccuaggcugauuuacucauccuuauguccaaaaguacuauucacuguugcagcacuugaacugcauccucuuugauagcuuaagacauuuugcaugcaugucagacacaaucccauguucccauacuacuacaaaaugccacauaacaggccuucaguaagugaagaaaaaaaagugaaguguugacuuugugguaguguugaaaaccugcuuaguggacagcauuuaaaacuagagaaagggauuaucaagaaaaguuuauuaugugacuguagugguuuucuaauaucguaauuuguuuuuuucuuuguaguauuuaugcguugccaguugagcagguuacagaaaggacaugcaacagaugaaugguuucuacuaaguucccauauaccacuaaaagguauugaaccaggaucuuugcguguucgagcacgauacuccauggaaaaaaucaugccagaagaagaguacagugaauuuaaagagguauuguuuacuaguuuaaucguuuuuaaugauacuaaacagaaauauuuacuauuuaauaaaacuccauuaaguuaaauaguaacacccuauauuaauggcagagaagaagccagauguaaaaaacacauacugugauuuugaucuuaaugagacuaggaauauaaagucaauuuuuaacaauuguauucaguagauauguuuuuucaauuggucuuguuguguacuuucagcagucuuuacuuaugucacuuuuagcuuauacugcaaaaggaacuucaugucgucuaugcuuuaucacauguauguggacaagaccgaacacuacuggccagcauccuacuaaagauauuucuucaugaaaagcuugaaucauuguuguuaugcacacuaaaugacagagagauaaguauggaagguaauauaugugugaucaacagugguguaauauuuaucauauuaccugaguuuguacuuaguaacucaugaguagaagucauaaaauacuaguguauuuuauuucuacauucuauaucaguuccaaggccacuguaacauauuacuauguuuuucacagauuccuaaucuauuuucucccagcacuuugauuuggugacaauccuugccuucuuuaaccauaaaaauuacaaaaauuaauuugucaaggaguagauaaaaugguacauauuuuuuuuuauaucuggugacauuuguauaagaaagcauuuaauuggggccuugcuugcaguuucagagauuuaauauuuuaucauuauggcaguauuaagcuugguagcauguaggcaaacacuguagcaguagccaagagcuauauccugaucuguaggcacagagagagacucuaggcuuaguagaugggcuuugaaaccucaagccgaucucuagugacaacacuuccuccauaagggcaaacuuccuaacccuucuaaucuucaaauagugucacuccugguaaauaagcauucaaauauuugagccuaugaggaccauucuuacucaaaauaccacagagaugaaguaauuuauuuuugguuaugaaaucaguagaaaguuuguguuuaucacaaacugguguucaacacacuggagaacuauuuugaaucuuuucauaugaacaugaugguguuuuuuucuucucacuuaugauagucaugauuuaauucacucugagaucaggugauuuaaugcauguuaaccccaacauauguauguaaaaagcacauuacuaaagaaaauuaauuuaauuuucagaguaguuauauuaguacaguucuguaaauacaaugaaacauccauuuuuguguagaugaagccacuacccuauuucgagcuacaacacuugcaaguaccuugauggagcaguauaugaaagcuacugccacacaguuuguucaucaugcuuugaaagacuccauuuuaaagauuauggaaagcaagcaaucaugugagguaagaauuuauaguuuuauucuuugcagcaaauagcauauuuuaaugagaacuuuaaaaaaugacaucuuuaggaaaguacaucauuucugagauguaucaguacaaucguguucucuaguauauuuauaauccaccucuccuugagcacauacaaagcucuuugagcauuucuuuuauuauauuaaugaccaaacauacuuugccuugagagaauguguauaacguuaauugaacacuuuucuagagacuuuuguacguguugaguaucuguuauuggaaaaaaagaaguauuuuaaaacauuuggaugauuucauauauacaauaaaguauccugggaauggaaccuaagucuaugacugaaguuaauuuuacaugaauucuuggaggcuuguguuaugguuugcacaucaugugaaguuggauauggaauuucccacauggauaaugccaugucagcaaccaaagucaaacuucaagagggcuuaccuugaguaauauguuguaacaucuucucucuagagggauuucuggguuauuuuauagaagauggggauuaaaagaagaugaaauaaucuuuuaaagaugauuaagguugcacugugaguuuauaggcagcccauaccauugaguagaaucacucguacaugacuguucuacuucaugaaugcuacagagcaauuucaaagaaagacaguauacauuuuuaggcuugauauagugucaauaaaauaacgaaauacuuuucaacacuuggagcuguaaaauguuaauugugccacaacaaaaugagugacuuaaguugaggguaaucccacaauuacccuuacuaugaaagcugacauagcuuucauauuuguagauaaaucuagcagaccagaacacuuggaugguggggaggagggguguacuugaagggucaugauuuuacuuaauauauuuugauuauuuuccuuagccacuaaguuguaccucauuaaaaacagcuuuucuucuuauauaaacagaacugaguaguuaaauauuaguugagaaacuaauuuuagcaaacuuacugcauuuguauauguggaacagguaacagcuuugaaaacgacuacucacuuaucacaauuuacuugaaauucaaucaucacaaaaaauaaauuuguauuucucuuaguuaaguccgucaaaguuagaaaaaaaugaagaugugaacacuaauuuagcacaccuauugagcauacuuucagagcuuguggagaaaauauucauggcuucagaaauacuuccaccguaaguugccaaauuuuuguuuugucuuuuaaugaaugauuuuuauuaucuuggcauuauacucagacuuuuaguccuuaaaagauggauuauauuuaagggaaagagaguaaaagaaugaguaaaauaacuguuaaagaagcuagauaaaaucacaggcauuguggcacaugucuguaaucccaguauuggagagguugggucaagaagagcauaggccagccuaaaaacauguauuuacaaauuagauuguauguuuuuguggaccaaguaagucuggcuuauauuuuagcuuagggagugauugaaaugucucaaaucuggggacaguaucuggaaauuuagugguuauuucuugccucgcauuagauuuccugcaaacaaaaaaagaaguuuaaaucuauucucauuucuaauaacuuguuucauacuuuucauuaacacagaauuuacaaugcauugagcuaagcauacuggauuauguuucuauauccaucacugaauguuuuucucauuacuuuugacaaaaccuuuuuuagaugagaaacccaaaugcauuaaaauaugguauacaguuuggguaaauuaaaauuuuaguugcaacuagauuaugaugaugcuuacuuucuguauugagacauuuauguuauuuuggcaggacacugagauauaucuauggguguuuacagaaaucaguucagcauaaguggccuacaaauaacaccaugagaacaagagucguuagguaagagucacuuuuucauuugucauagacauuguauagaacacacacuugauuuguuuauguaggcaaaaauacagaaacuuguugcuuggggaaauaccguaauugaaccaucuggauuuuaauucguuuguagcauguagaucuccagccuugccguguaauucugaagcugugauucagugugcucauaggacauuaaggacugcuuuggcacucauuaucacucuccagugaggaagcacagcuacagagauuacauuguuugcuugaguuauaaacuuaauuucuaaaaccaucuaaaaaucuuguucaaacauuuugguaagcauaucucagcuaguacacagugacuagaaauuuaauagaaauacaucaaauacagcaguuuucuaguaauuauggaaaauacacaguauauguacaaauguaaagugaguuuuaaagaccuguuucuaauguaaauucucugaagagaauucuacuuuucuuacaggcagaaugucuaauagugcccugagggcacagcucaguggugggguacuagcuuaacacuaagagguccuggauuugauuccuaccgcugaauaaaacagccaaccaaaacucaaguagcugugccaagacauacugaagaauuguaggaaugaagaaaaugaaaagcacaguauuucagcagcugugugugauguacaauaaacuguucuguacuuuaaaugugcuuaaauauguguaacuguuaaacuaauacagcagggaguccucugguuggauuaauaaugacaguguacuuuagaggcuuuugugccugaggugauuucucuuccuagucaucuuuaaauuguguaguacccauguauuauucaauuuaaaaucaccuuaaaaauuuaaaaauauuuuuuucacugagauuuagguuuuuaguucccagacccuacuaaaguaucaaaaugcuucagaaaaccuuaugaaggaaccuucacuaugggggaaaaaucauaaugugaagaguuauuaauuauuguaaguaaucuguagaaggaacuucaaaacuauggggaaccauguauucuuuaagaagugaaauugaucuuacaugacaacauauacagagugggauaucuauugaagcuuacacuaacugcaguucucaaaguaaaacugaugucaaccauagccacuguugauaagccaugauaaguucuguuacuuugaaauucaacaacuuuuaaagaaaacuuuaaaaauuguaguaucagccggguggugguggcacacgccuuuaaucccagcacuugggaggcagaggcaggcggauuucuguguucgaggccagccuggucuacagagugaguuccaggacagccagggcuauacagagaaacccugucucgaaaaaccaaaaaaaauaaaaauaaaaaauuguaguaucauugaaagccuuugaguguuuacugaauacauuuucauugguucaggugucacuuauaaugacaauguauuaaacuguuuauauaaguugugagcaguuuugauauaaccaacuuaauuuacucucauggauuuguuuguuuguuuguuuguuuaaauaaacuucaaaagacagacaagagaguggaugauuugaaaccuuacagcauguaccuauaaaaggcuuauuucacucuucauaaucuuacagcaaaucucaauguguuuaauaaacuguuuacucuaguagaaaaugaauuacuaaucuacuauaaacagguaagagguuuaugugcaaguuuuccaaaguuagucuguaaguuugcuuuauaaguuucuuaauaacuucguuuaggcuucccuauguugagaguaaauguuaugguucuaaguuuaaguuuuuuguuuauaauguaaguuuucuaaaaagaauuuuuucuuucaauuagugguuuuguuuuucuucgccuuaucugcccugcuauccugaauccacggauguuuaauaucaucucagguaauuaccuuuuaauauauuuucaaaugagaaaaaaaucuguauuuucauauuugauaaaaauacuugccuuuuaaaucaaauuaaaaaaauucaagauacaaauaaaacuugccugcuuugucuuuuaguaucuaagauuuuuuuguccugugacucauuuuuuuuauuuuaaaaagucuacauuguagucacuugagcacguguguguguguguguguguguguguguguguguguguguguguguguguauauaugggcauuugcuuguuauggagcauguguagggaucagaggucagcucuugggagaugacugucucucuucaccaucugagugccuaggauugaaaucaggacaucaaacuugguggcaagcacguuuaccacucuugcuggccugcuggcucugacaaguguuuguaggagauuaggaagggcucuuguucuuguguccuuugccuacaucagguuacuguaagguaaacuuucugcuaagaucagguuaaagaccuaugugcagccacauuagcaaucugugaacacuuacaaagauagcccaagauucuuuuuaauaagcuugaccccauuuugcuuuucacucacuguccacaggacaaaauuuuaagauuuguaagcuuaagaaaaaguauugauguuucuuacucuaauguuguaaugaguccauuaacauuaauagaaggaaacagucauuugcaugcuauacuuugaaccucaaaucuguauuaaaauuuauuugaggugggacuucauucuggaauucuguaaucccagaacuuaggaggcuaagguacaaaaaagcccaagacaaaccugggcuuuguagccagacuaugucacuaaacacagugguauguaucuacaaugcccauaugcaugaauggugagucuaagagucccccugaucuuaaaaucaaagggaagaccauaguuuuuuucacuauuauuauguuuauacuccucacauuccugcaauuuuuauuaauacuaaggugauugaaaugaugcauauuaagaauaaaagacuggguguaaugguucaguguuuaagaacauacacugcucuuacagagaaccugaauucacuuccaaacacccauggcagguggcucacaaccacuuaugacuccaucuccaagggaucagacacuggucuugguucuguggguagcugcacucauuuguacauacccacaccaaaguauacauaacuuuuuuaaaauuaaaaggcuuagaauuuuugagcgcucuaucuaaacauuggccuuaaacugccacuuuaauacaaaacagugagucaaaauguuaauaguugcuggcugagaauguaacuaagcugguggaacacuggcagaguauacaugaggcccuggguucaaccccuuguaccugauaagagaucagaaacucaagguuguccauggacauggguggggccuuaauugucaguuucuguuugguagcuacaaauacuuuucauuuacauuccauuuucucuguucuacagggaacuguuucaugaacucaaaaacugauguauaaauugagcuaguugccugcaaauaauguugggaacagggaauugcuaagauugcaaaaugcuccccuauguggguugaauuagcuuugggcauggucugaaaguuuuuagagugagagucuucuuagcaauaaagcagcuuuuugaaguauucugaaauaucagccaguuggaaauuacuccuuuaguuuccuuuucacaaaacaagcacugauaaguauguucaauuuucccuuuuaauucaaguucuuuugaauuaagugauauauuuucaaggacuauugugaauauauucugaauaaaggauuguuggcacuuuuaauauuucuuuaguguuaauacuaaguguuugaccauuuaucugaaaguaaccucuggagucggugucauuggcuauacccaauuuucuucuagauuccccaucuccuauugcugcaagaacacugacauuaguggcuaaaucugugcagaauuuagcaaaucuuguggaauuuggagcuaagguaaacauauuuugauaauuaaauuaauaacauuuuaaauggaaauuuaaauucacaaugaauauauaccagaucuucaaaacaugauuggaaugauauaguuaucugcuuuugugacuuaguauaugacauauuuguucauaaauucacauguacauaccacuagucaguaugcaguccuuuaacugauguucaaauguaacaaguauucuuuacacuuccauucagacuuguccuaaacuuugggguaugguuaauaauuaaauauacauuucaggcuuuugucauauauuccauuuuccauuuuugguuauuauuauuucuugccagauucauuuuuuucuaaaaagauuuauucacuuuuauguguaugaguguuuugccuguaugugcguuaagugcacugguauguaccuugugccuacaugggccagaagaggacagaguauauuauauuauauucucaggaacauaacaguuguaagucaccaucugagugcuggcaagugagcccugguccugcucugcaaguguagcaggcgcucuuaaugcagaggcgucucagcagcccacagauccuuaucucuguucaucugcuggggguguucguguguuucauuguuguucuuccaauuucaugucuacaucuuugggauuuccaauugaauguuaucccauuugaagccuguuguugauacuuuacuaacuagaaauuauaaauuauaguggguuaggauuuuaguuuaaguaguuuacauuuauggguuauuguuugaaauuuccugaaacccaaagcguauuuugcagucauagggaguuuuugguuucacuguauuuuauuuaauuccuuauaauguguuggauucuucauaauuuaucaguaauuaauucuaaaucuauauauaaacaauuugggucugccaagcuauauguuuaaugauuuuuaauuuguaauuuaauuuugaaucuucauuaaauaccuccauuccucccacgaaacuguuuauauuaaagagaaauuuugcaugaauaaauacuaauucuugcaacauguauaguuuuuguuguaaaacaguucuuuuaagguauaugagauggaaguuuuaaauuuuuuaggagccuuauggaaguuuuuaauuuuuuuaggagccuuauauggaaggugucaauccauuuauaaaaaguaauaaacaucgcaugaucauguuuuuagaugaacuugggguauguauauaauuuucaaguucuuugagaaugagcuuagccauaugaguaauaaccuuuaaauuuuaaaaccaggacuucaaaauaaaaucuuuucuauccaaaaugucuuuuucacuuauucuuguuuauaucaagcauacacaauuguggcuuucaaccagucaucuuucaggcugucuuuucauucauacccuuuagcuauuguuggauuuaguaaccuuuuaaguuguagcugaaacaagauuugaagccauuuauauuggaacuaaaguuagaacuaaaugaaauaauauaauuauuauaccucacuugagcuuuuauaaauuaaacugauacaaaauugaacauauucauaauuucugagacccuaaauaauaaaguuaaauuuucuaccccauauacauuucuaacacugaaugaauuuuuaaguaaauauauucauaaugugguauguauacacggagaccaaggugaaauuagcacgcaugugugaguuuagccaaguuugucaucaaaaguauaggcgauucaguuguaguaguguauuucgacucagugauucauuuuaaaacaaaugucaaaagcccuuuuuggcaaacaaaugggguuagaaggaagaccgacaacauaaguucuauauuuauaagaaacauuuaugugagcuucugcaaagauucuauuaggaguacuucuaauuauuggcauuuaaugcaauaauacgguauuauacauuuauuaugauggcuaaguuacuucaugaagguuaaacauguuaauguccaauaaucccauauuuuagaauuaucuugagcacagucuauagaaauugcaaacaaugaauuuuuauuauacuuucauaauuuaguucuuuagauguugguuaauuuagauaagaguacuguaguaguauucagucuaggaguuuuaaguuguaaugguaucauuuauuuugcauaugcucuaaauuuaaaaaagauucacacugucauucuaugaaaguugaagaaccuggcuucuuuguaaauagauguccuauaacccauguucagcagaauuacuugaauaaaaauuuuuguacaaauuaauguuuuauaccuaguuaggauaacuuuagaagagacuacaaggguuuuuauuucuaaacgcaguuuuaugauucccuuaaagaauguaccugaacuuccggacacuacagagcauucuagaacugaccugucucgugacuuagcagcauugcaugagauuuguguagcucauucagaugaacugagaacacucagcaaugagcgugguguacagcagguagguuuuacauggcaauguuccugcuuuauaaaugguacauguaaaaauggcaagugaguuacugucaguaguaagaaggcaugguacucuuucaguuacucucauaccaagugugugagcaaaacuacuugugaagcacaggagaacuauauaagaaaugugaaaaauaacuacagaggauacauuauuauagugauucaaguugguaugguacauaacucauaccuuaaaaaucaguccacauuaagcuuuugcuguccaguagaacuguaaagauacuuuaauugauuuagugauaaguuacuggagauagucucucuuaagcuaagguaguuaaauggagagaaaaggguaucacauaggaaaggauaaaucaagauagaccauccuaagucugauuaauuagccugcgaggcuagaauccaagcaguccuaacuaguuaagaguacaauuggaaaauauugcuauuguuuaacuuagauuuuucaagauuuaauaaugacaaaauuuaguguaguaagaccuucuauauuuugguuacaacuaaaaauacucaguuuaugucuugaguagaaucucaguccuuugauauaguuuuuaucaaaaguaauaaauccuauaauugaaauuuuaagcucuuuauuugcuuagugauuuuuuuccucacuauuucuccugugucuagcacguacugaaaaagcuucuggcgauaacagaacugcuucaacaaaaacaaaaccaguauacaaaaaccaaugacaucagguagcagccuguguucugcguggauucaguaugcccaccgugguaauucacaccaucaugucuccuuugcucuugccaaaaagaaaaaaauagagaaagaaaaaaaauagcacacuuucccacauuccagugaugugugagcuaugcaagcaaaaacccaagauucugcugaagagcaacugccagcaccuuuguaagcuaucugugcagaauauugcgcacuuuuuccacauggaaucucuaccaaacucugagccuugguguacccuuaacaacaacaaaaaugcuaugacugacugugucuugaacuuugaaaauauauuuucaguauauccaauugccaaaguuuugcugucucuuggaaaaggaacuaugaaaucaacugacaaggaaacgcauucuauagacaacagaauuuaacuggaucgcagacaguuauuacuguaauuucuucuuuaugaacaugaccauuugacuguucacugacuuucuuuguauuuacaguuuccagaguuugacauuauaauaggaacaaucuugcuguauacuuuuuaaaaauacugugcuauucuuucuggaacuguugaaagacaauauauaaaaucgaugaaucuauugcucaucagcuuuauuuuuuaaacauaccacuuauuuuguuggaauugucaaagacuguauuuagaucucaugcuuuuguuaaaauguuuacaacaguaaauaguuuaaauucaauaaauauuauuggucauuguaccaauuauugcauguuacccauuugaccauuuuauagauugcugaugucuuuuauguuuaaacgaagugcuagaauacuuuugucacuucuaagaugguuuuuguuaucuuugauuaugcagauaaccuaaucagccacuuaacaacuuacacaucuuuuaauuuguacuuguuuuaccugcuggauauuuaguuuguauaguucauuugcucuuguguauguauuuuugugugaaguauucacaaggguuaaguuaaaauaaacuaagggauagcuugcauaacugauuagcuuacuauuuaacuuuauuauaauuuucuucccacuauagggauaguucaagcuuuaauaucagagcaaaaucaggguuauuuuuauuguuucuuucacaaaggaguccauuuauuuacucaauauacaacuuguuaauugaagaccggauuuaaaaacaguauguagcagaggauucuuagugaucaaaauagguuuguuguuuucuuuuuuuaaagaaccaccaagggagguacuaaggaagguauuaauaaaguuuucucaauaaaaauauuuuucugaaggccuagauccauaaagcauucgauuguauuucucaagagauauuguauacaaggaaaaauguuaaguaaucaaggucuauu
